US009149506B2

(12) United States Patent
Chakraborty et al.

(10) Patent No.: US 9,149,506 B2
(45) Date of Patent: Oct. 6, 2015

(54) MODIFIED POLYNUCLEOTIDES ENCODING SEPTIN-4

(71) Applicant: Moderna Therapeutics, Inc., Cambridge, MA (US)

(72) Inventors: Tirtha Chakraborty, Medford, MA (US); Antonin de Fougerolles, Waterloo (BE)

(73) Assignee: Moderna Therapeutics, Inc., Cambridge, MA (US)

( * ) Notice: Subject to any disclaimer, the term of this patent is extended or adjusted under 35 U.S.C. 154(b) by 0 days.

(21) Appl. No.: 14/107,079

(22) Filed: Dec. 16, 2013

(65) Prior Publication Data

US 2014/0141067 A1 May 22, 2014

Related U.S. Application Data

(63) Continuation of application No. PCT/US2013/030070, filed on Mar. 9, 2013.

(60) Provisional application No. 61/618,862, filed on Apr. 2, 2012, provisional application No. 61/681,645, filed on Aug. 10, 2012, provisional application No. 61/737,130, filed on Dec. 14, 2012, provisional application No. 61/618,866, filed on Apr. 2, 2012, provisional application No. 61/681,647, filed on Aug. 10, 2012, provisional application No. 61/737,134, filed on Dec. 14, 2012, provisional application No. 61/618,868, filed on Apr. 2, 2012, provisional application No. 61/681,648, filed on Aug. 10, 2012, provisional application No. 61/737,135, filed on Dec.

(Continued)

(51) Int. Cl.
| | | |
|---|---|---|
| C12N 15/85 | (2006.01) |
| A61K 38/17 | (2006.01) |
| C07K 14/47 | (2006.01) |
| C07K 14/62 | (2006.01) |
| A61K 48/00 | (2006.01) |
| A61K 31/7115 | (2006.01) |
| C12N 9/88 | (2006.01) |
| A61K 9/127 | (2006.01) |
| C12N 15/11 | (2006.01) |
| C07K 14/705 | (2006.01) |
| C07K 14/505 | (2006.01) |
| C07K 14/535 | (2006.01) |
| C12N 9/64 | (2006.01) |
| C12N 9/10 | (2006.01) |
| C12N 9/00 | (2006.01) |
| C12N 9/42 | (2006.01) |
| C12N 15/87 | (2006.01) |
| C12P 13/04 | (2006.01) |
| A61K 38/45 | (2006.01) |
| C07K 14/005 | (2006.01) |
| C12N 9/16 | (2006.01) |

| C12N 9/24 | (2006.01) |
| C12N 15/52 | (2006.01) |
| C07K 14/435 | (2006.01) |
| C12P 21/00 | (2006.01) |
| C07K 14/485 | (2006.01) |
| A61K 38/00 | (2006.01) |

(52) U.S. Cl.
CPC ............ *A61K 38/177* (2013.01); *A61K 9/1271* (2013.01); *A61K 31/7115* (2013.01); *A61K 38/17* (2013.01); *A61K 38/45* (2013.01); *A61K 48/005* (2013.01); *A61K 48/0033* (2013.01); *A61K 48/0066* (2013.01); *C07K 14/005* (2013.01); *C07K 14/435* (2013.01); *C07K 14/47* (2013.01); *C07K 14/4705* (2013.01); *C07K 14/4713* (2013.01); *C07K 14/485* (2013.01); *C07K 14/505* (2013.01); *C07K 14/535* (2013.01); *C07K 14/62* (2013.01); *C07K 14/705* (2013.01); *C12N 9/1051* (2013.01); *C12N 9/16* (2013.01); *C12N 9/2402* (2013.01); *C12N 9/2445* (2013.01); *C12N 9/6451* (2013.01); *C12N 9/88* (2013.01); *C12N 9/93* (2013.01); *C12N 15/11* (2013.01); *C12N 15/52* (2013.01); *C12N 15/85* (2013.01); *C12N 15/87* (2013.01); *C12P 13/04* (2013.01); *C12P 21/00* (2013.01); *A61K 38/00* (2013.01)

(58) Field of Classification Search
None
See application file for complete search history.

(56) References Cited

U.S. PATENT DOCUMENTS

| 2,008,526 | A | 7/1935 | Wrappler et al. |
| 3,552,394 | A | 1/1971 | Horn et al. |
| 3,737,524 | A | 6/1973 | Ebel et al. |
| 3,766,907 | A | 10/1973 | Muenzer |
| 3,906,092 | A | 9/1975 | Hilleman et al. |
| 4,373,071 | A | 2/1983 | Itakura |
| 4,399,216 | A | 8/1983 | Axel et al. |
| 4,401,796 | A | 8/1983 | Itakura |
| 4,411,657 | A | 10/1983 | Galindo |
| 4,415,732 | A | 11/1983 | Caruthers et al. |
| 4,458,066 | A | 7/1984 | Caruthers et al. |
| 4,474,569 | A | 10/1984 | Newkirk |

(Continued)

FOREIGN PATENT DOCUMENTS

| CA | 2376634 | 12/2000 |
| CA | 2473135 | 6/2003 |

(Continued)

OTHER PUBLICATIONS

Warren, L. et al. Highly efficient reprogramming to pluripotency and directed differentiation of human cells with synthetic modified mRNA. Cell Stem Cell. Nov. 5, 2010;7(5):618-30.

(Continued)

*Primary Examiner* — Jim Ketter
*Assistant Examiner* — Antonio Galisteo Gonzalez
(74) *Attorney, Agent, or Firm* — DT Ward, P.C.; Donna T. Ward; Jennifer F. Bryan

(57) ABSTRACT

The invention relates to compositions and methods for the preparation, manufacture and therapeutic use of oncology-related polynucleotides, oncology-related primary transcripts and oncology-related mmRNA molecules.

15 Claims, 4 Drawing Sheets

Related U.S. Application Data 14, 2012, provisional application No. 61/618,870, filed on Apr. 2, 2012, provisional application No. 61/681,649, filed on Aug. 10, 2012, provisional application No. 61/737,147, filed on Dec. 14, 2012, provisional application No. 61/681,650, filed on Aug. 10, 2012, provisional application No. 61/618,873, filed on Apr. 2, 2012, provisional application No. 61/737,139, filed on Dec. 14, 2012, provisional application No. 61/618,878, filed on Apr. 2, 2012, provisional application No. 61/681,654, filed on Aug. 10, 2012, provisional application No. 61/737,152, filed on Dec. 14, 2012, provisional application No. 61/618,885, filed on Apr. 2, 2012, provisional application No. 61/681,658, filed on Aug. 10, 2012, provisional application No. 61/737,155, filed on Dec. 14, 2012, provisional application No. 61/618,896, filed on Apr. 2, 2012, provisional application No. 61/668,157, filed on Jul. 5, 2012, provisional application No. 61/681,661, filed on Aug. 10, 2012, provisional application No. 61/737,160, filed on Dec. 14, 2012, provisional application No. 61/618,911, filed on Apr. 2, 2012, provisional application No. 61/681,667, filed on Aug. 10, 2012, provisional application No. 61/737,168, filed on Dec. 14, 2012, provisional application No. 61/618,922, filed on Apr. 2, 2012, provisional application No. 61/681,675, filed on Aug. 10, 2012, provisional application No. 61/737,174, filed on Dec. 14, 2012, provisional application No. 61/618,935, filed on Apr. 2, 2012, provisional application No. 61/681,687, filed on Aug. 10, 2012, provisional application No. 61/737,184, filed on Dec. 14, 2012, provisional application No. 61/618,945, filed on Apr. 2, 2012, provisional application No. 61/681,696, filed on Aug. 10, 2012, provisional application No. 61/737,191, filed on Dec. 14, 2012, provisional application No. 61/618,953, filed on Apr. 2, 2012, provisional application No. 61/681,704, filed on Aug. 10, 2012, provisional application No. 61/737,203, filed on Dec. 14, 2012, provisional application No. 61/681,720, filed on Aug. 10, 2012, provisional application No. 61/737,213, filed on Dec. 14, 2012, provisional application No. 61/681,742, filed on Aug. 10, 2012, provisional application No. 61/618,961, filed on Apr. 2, 2012, provisional application No. 61/648,286, filed on May 17, 2012, provisional application No. 61/618,957, filed on Apr. 2, 2012, provisional application No. 61/648,244, filed on May 17, 2012, provisional application No. 61/681,712, filed on Aug. 10, 2012, provisional application No. 61/696,381, filed on Sep. 4, 2012, provisional application No. 61/709,303, filed on Oct. 3, 2012, provisional application No. 61/712,490, filed on Oct. 11, 2012.

(56) References Cited

U.S. PATENT DOCUMENTS

| | | | |
|---|---|---|---|
| 4,500,707 | A | 2/1985 | Caruthers et al. |
| 4,579,849 | A | 4/1986 | MacCoss et al. |
| 4,588,585 | A | 5/1986 | Mark et al. |
| 4,668,777 | A | 5/1987 | Caruthers et al. |
| 4,737,462 | A | 4/1988 | Mark et al. |
| 4,816,567 | A | 3/1989 | Cabilly et al. |
| 4,879,111 | A | 11/1989 | Chong |
| 4,957,735 | A | 9/1990 | Huang |
| 4,959,314 | A | 9/1990 | Mark et al. |
| 4,973,679 | A | 11/1990 | Caruthers et al. |
| 5,012,818 | A | 5/1991 | Joishy |
| 5,017,691 | A | 5/1991 | Lee et al. |
| 5,021,335 | A | 6/1991 | Tecott et al. |
| 5,036,006 | A | 7/1991 | Sanford et al. |
| 5,047,524 | A | 9/1991 | Andrus et al. |
| 5,116,943 | A | 5/1992 | Koths et al. |
| 5,130,238 | A | 7/1992 | Malek et al. |
| 5,132,418 | A | 7/1992 | Caruthers et al. |
| 5,153,319 | A | 10/1992 | Caruthers et al. |
| 5,168,038 | A | 12/1992 | Tecott et al. |
| 5,169,766 | A | 12/1992 | Schuster et al. |
| 5,194,370 | A | 3/1993 | Berninger et al. |
| 5,199,441 | A | 4/1993 | Hogle |
| 5,240,855 | A | 8/1993 | Tomes |
| 5,262,530 | A | 11/1993 | Andrus et al. |
| 5,273,525 | A | 12/1993 | Hofman |
| 5,298,422 | A | 3/1994 | Schwartz et al. |
| 5,332,671 | A | 7/1994 | Ferrara et al. |
| 5,399,491 | A | 3/1995 | Kacian et al. |
| 5,409,818 | A | 4/1995 | Davey et al. |
| 5,426,180 | A | 6/1995 | Kool |
| 5,437,990 | A | 8/1995 | Burg et al. |
| 5,457,041 | A | 10/1995 | Ginaven et al. |
| 5,466,586 | A | 11/1995 | Davey et al. |
| 5,484,401 | A | 1/1996 | Rodriguez et al. |
| 5,514,545 | A | 5/1996 | Eberwine |
| 5,527,288 | A | 6/1996 | Gross et al. |
| 5,545,522 | A | 8/1996 | Van Gelder et al. |
| 5,554,517 | A | 9/1996 | Davey et al. |
| 5,580,859 | A | 12/1996 | Felgner et al. |
| 5,588,960 | A | 12/1996 | Edwards et al. |
| 5,589,466 | A | 12/1996 | Felgner et al. |
| 5,663,153 | A | 9/1997 | Hutcherson et al. |
| 5,665,545 | A | 9/1997 | Malek et al. |
| 5,672,491 | A | 9/1997 | Khosla et al. |
| 5,674,267 | A | 10/1997 | Mir et al. |
| 5,677,124 | A | 10/1997 | DuBois et al. |
| 5,679,512 | A | 10/1997 | Laney et al. |
| 5,693,622 | A | 12/1997 | Wolff et al. |
| 5,693,761 | A | 12/1997 | Queen et al. |
| 5,697,901 | A | 12/1997 | Eriksson |
| 5,700,642 | A | 12/1997 | Monforte et al. |
| 5,702,384 | A | 12/1997 | Umeyama et al. |
| 5,703,055 | A | 12/1997 | Felgner et al. |
| 5,712,127 | A | 1/1998 | Malek et al. |
| 5,716,785 | A | 2/1998 | Van Gelder et al. |
| 5,736,137 | A | 4/1998 | Anderson et al. |
| 5,756,264 | A | 5/1998 | Schwartz et al. |
| 5,759,179 | A | 6/1998 | Balbierz |
| 5,766,903 | A | 6/1998 | Sarnow et al. |
| 5,773,244 | A | 6/1998 | Ares, Jr. et al. |
| 5,776,456 | A | 7/1998 | Anderson et al. |
| 5,789,554 | A | 8/1998 | Leung et al. |
| 5,807,707 | A | 9/1998 | Andrews et al. |
| 5,824,307 | A | 10/1998 | Johnson |
| 5,824,497 | A | 10/1998 | Andrews et al. |
| 5,840,299 | A | 11/1998 | Bendig et al. |
| 5,843,439 | A | 12/1998 | Anderson et al. |
| 5,848,996 | A | 12/1998 | Eldor |
| 5,849,546 | A | 12/1998 | Sousa et al. |
| 5,851,829 | A | 12/1998 | Marasco et al. |
| 5,861,501 | A | 1/1999 | Benseler et al. |
| 5,869,230 | A | 2/1999 | Sukhatme |
| 5,889,136 | A | 3/1999 | Scaringe et al. |
| 5,891,636 | A | 4/1999 | Van Gelder et al. |
| 5,914,269 | A | 6/1999 | Bennett et al. |
| 5,955,310 | A | 9/1999 | Widner et al. |
| 5,958,688 | A | 9/1999 | Eberwine et al. |
| 5,962,271 | A | 10/1999 | Chenchik et al. |
| 5,962,272 | A | 10/1999 | Chenchik et al. |
| 5,965,720 | A | 10/1999 | Gryaznov et al. |
| 5,965,726 | A | 10/1999 | Pavlakis et al. |
| 5,980,887 | A | 11/1999 | Isner et al. |
| 5,989,911 | A | 11/1999 | Fournier et al. |
| 5,994,511 | A | 11/1999 | Lowman et al. |
| 6,004,573 | A | 12/1999 | Rathi et al. |
| 6,019,747 | A | 2/2000 | McPhee |
| 6,022,715 | A | 2/2000 | Merenkova et al. |

(56) References Cited

U.S. PATENT DOCUMENTS

| | | |
|---|---|---|
| 6,057,494 A | 5/2000 | Koops et al. |
| 6,063,603 A | 5/2000 | Davey et al. |
| 6,074,642 A | 6/2000 | Wang et al. |
| 6,090,382 A | 7/2000 | Salfeld et al. |
| 6,090,591 A | 7/2000 | Burg et al. |
| 6,096,503 A | 8/2000 | Sutcliffe et al. |
| 6,100,024 A | 8/2000 | Hudson et al. |
| 6,124,091 A | 9/2000 | Petryshyn |
| 6,132,419 A | 10/2000 | Hofmann |
| 6,147,055 A | 11/2000 | Hobart et al. |
| 6,177,274 B1 | 1/2001 | Park et al. |
| 6,187,287 B1 | 2/2001 | Leung et al. |
| 6,190,315 B1 | 2/2001 | Kost et al. |
| 6,210,931 B1 | 4/2001 | Feldstein et al. |
| 6,214,804 B1 | 4/2001 | Felgner et al. |
| 6,217,912 B1 | 4/2001 | Park et al. |
| 6,228,640 B1 | 5/2001 | Cezayirli et al. |
| 6,234,990 B1 | 5/2001 | Rowe et al. |
| 6,235,883 B1 | 5/2001 | Jakobovits et al. |
| 6,239,116 B1 | 5/2001 | Krieg et al. |
| 6,251,665 B1 | 6/2001 | Cezayirli et al. |
| 6,255,076 B1 | 7/2001 | Widner et al. |
| 6,258,558 B1 | 7/2001 | Szostak et al. |
| 6,261,584 B1 | 7/2001 | Peery et al. |
| 6,265,387 B1 | 7/2001 | Wolff et al. |
| 6,265,389 B1 | 7/2001 | Burke |
| 6,267,987 B1 | 7/2001 | Park et al. |
| 6,291,170 B1 | 9/2001 | Van Gelder et al. |
| 6,300,484 B1 | 10/2001 | Duhl |
| 6,303,378 B1 | 10/2001 | Bridenbaugh et al. |
| 6,303,573 B1 | 10/2001 | Ruoslahti et al. |
| 6,322,967 B1 | 11/2001 | Parkin |
| 6,326,174 B1 | 12/2001 | Joyce et al. |
| 6,334,856 B1 | 1/2002 | Allen et al. |
| 6,355,245 B1 | 3/2002 | Evans et al. |
| 6,368,801 B1 | 4/2002 | Faruqi |
| 6,376,248 B1 | 4/2002 | Hawley-Nelson et al. |
| 6,395,253 B2 | 5/2002 | Levy et al. |
| 6,399,061 B1 | 6/2002 | Anderson et al. |
| 6,406,705 B1 | 6/2002 | Davis et al. |
| 6,410,276 B1 | 6/2002 | Burg et al. |
| 6,413,942 B1 | 7/2002 | Felgner et al. |
| 6,433,155 B1 | 8/2002 | Umansky et al. |
| 6,440,096 B1 | 8/2002 | Lastovich et al. |
| 6,455,043 B1 | 9/2002 | Grillo-Lopez |
| 6,491,657 B2 | 12/2002 | Rowe et al. |
| 6,500,419 B1 | 12/2002 | Hone et al. |
| 6,500,919 B1 | 12/2002 | Adema et al. |
| 6,514,498 B1 | 2/2003 | Antonsson et al. |
| 6,514,948 B1 | 2/2003 | Raz et al. |
| 6,517,869 B1 | 2/2003 | Park et al. |
| 6,520,949 B2 | 2/2003 | St. Germain |
| 6,525,183 B2 | 2/2003 | Vinayak et al. |
| 6,527,216 B2 | 3/2003 | Eagelman et al. |
| 6,528,262 B1 | 3/2003 | Gilad et al. |
| 6,534,312 B1 | 3/2003 | Shiver et al. |
| 6,552,006 B2 | 4/2003 | Raz et al. |
| 6,555,525 B2 | 4/2003 | Burke |
| 6,565,572 B2 | 5/2003 | Chappius |
| 6,572,857 B1 | 6/2003 | Casimiro et al. |
| 6,586,524 B2 | 7/2003 | Sagara |
| 6,589,940 B1 | 7/2003 | Raz et al. |
| 6,610,044 B2 | 8/2003 | Mathiesen |
| 6,610,661 B1 | 8/2003 | Carson et al. |
| 6,613,026 B1 | 9/2003 | Palasis et al. |
| 6,617,106 B1 | 9/2003 | Benner |
| 6,623,457 B1 | 9/2003 | Rosenberg |
| 6,652,886 B2 | 11/2003 | Ahn et al. |
| 6,653,468 B1 | 11/2003 | Guzaev et al. |
| 6,664,066 B2 | 12/2003 | Parks |
| 6,670,178 B1 | 12/2003 | Selden et al. |
| 6,676,938 B1 | 1/2004 | Teti et al. |
| 6,696,038 B1 | 2/2004 | Mahato et al. |
| 6,743,211 B1 | 6/2004 | Prausnitz et al. |
| 6,743,823 B1 | 6/2004 | Summar et al. |
| 6,777,187 B2 | 8/2004 | Makarov et al. |
| 6,808,888 B2 | 10/2004 | Zhang et al. |
| 6,818,421 B2 | 11/2004 | Kossmann et al. |
| 6,835,393 B2 | 12/2004 | Hoffman et al. |
| 6,835,827 B2 | 12/2004 | Vinayak et al. |
| 6,890,319 B1 | 5/2005 | Crocker |
| 6,896,885 B2 | 5/2005 | Hanna |
| 6,900,302 B2 | 5/2005 | Teti et al. |
| 6,902,734 B2 | 6/2005 | Giles-Komar et al. |
| 6,924,365 B1 | 8/2005 | Miller et al. |
| 6,949,245 B1 | 9/2005 | Sliwkowski |
| 6,960,193 B2 | 11/2005 | Rosenberg |
| 6,962,694 B1 | 11/2005 | Soegaard et al. |
| 7,001,890 B1 | 2/2006 | Wagner et al. |
| 7,052,891 B2 | 5/2006 | Leung et al. |
| 7,074,596 B2 | 7/2006 | Darzynkiewicz et al. |
| 7,125,554 B2 | 10/2006 | Forsberg et al. |
| 7,135,010 B2 | 11/2006 | Buckman et al. |
| 7,195,761 B2 | 3/2007 | Holtzman et al. |
| 7,198,899 B2 | 4/2007 | Schleyer et al. |
| 7,202,226 B2 | 4/2007 | Murray et al. |
| 7,208,478 B2 | 4/2007 | Carson et al. |
| 7,226,439 B2 | 6/2007 | Prausnitz et al. |
| 7,226,595 B2 | 6/2007 | Antonsson et al. |
| 7,268,120 B1 | 9/2007 | Horton et al. |
| 7,276,489 B2 | 10/2007 | Agrawal et al. |
| 7,316,925 B2 | 1/2008 | Draghia-Akli et al. |
| 7,320,961 B2 | 1/2008 | Kempf et al. |
| 7,329,741 B2 | 2/2008 | Duhl |
| 7,335,471 B2 | 2/2008 | Guillerez et al. |
| 7,348,004 B2 | 3/2008 | Peters et al. |
| 7,354,742 B2 | 4/2008 | Kamme et al. |
| 7,371,404 B2 | 5/2008 | Panzner et al. |
| 7,374,778 B2 | 5/2008 | Hoffman et al. |
| 7,374,930 B2 | 5/2008 | Oh et al. |
| 7,378,262 B2 | 5/2008 | Sobek et al. |
| 7,384,739 B2 | 6/2008 | Kitabayashi et al. |
| 7,404,956 B2 | 7/2008 | Peters et al. |
| 7,422,739 B2 | 9/2008 | Anderson et al. |
| 7,476,506 B2 | 1/2009 | Schleyer et al. |
| 7,476,709 B2 | 1/2009 | Moody et al. |
| 7,479,543 B2 | 1/2009 | Tsuchiya |
| 7,498,414 B2 | 3/2009 | Zhu |
| 7,501,486 B2 | 3/2009 | Zhang et al. |
| 7,521,054 B2 | 4/2009 | Pastan et al. |
| 7,547,678 B2 | 6/2009 | Kempf et al. |
| 7,550,264 B2 | 6/2009 | Getts et al. |
| 7,575,572 B2 | 8/2009 | Sweeney |
| 7,579,318 B2 | 8/2009 | Divita et al. |
| 7,615,225 B2 | 11/2009 | Forsberg et al. |
| 7,629,311 B2 | 12/2009 | Tobinick |
| 7,641,901 B2 | 1/2010 | Goldenberg et al. |
| 7,667,033 B2 | 2/2010 | Alvarado |
| 7,682,612 B1 | 3/2010 | White et al. |
| 7,699,852 B2 | 4/2010 | Frankel et al. |
| 7,708,994 B2 | 5/2010 | Benyunes |
| 7,709,452 B2 | 5/2010 | Pitard |
| 7,718,425 B2 | 5/2010 | Reinke et al. |
| 7,737,108 B1 | 6/2010 | Hoffman et al. |
| 7,745,391 B2 | 6/2010 | Mintz et al. |
| 7,763,253 B2 | 7/2010 | Hedlund et al. |
| 7,776,523 B2 | 8/2010 | Garcia et al. |
| 7,794,719 B2 | 9/2010 | Bardroff et al. |
| 7,799,900 B2 | 9/2010 | Adams et al. |
| 7,820,161 B1 | 10/2010 | Curd et al. |
| 7,820,624 B2 | 10/2010 | Hart et al. |
| 7,829,092 B2 | 11/2010 | Lobb et al. |
| 7,846,895 B2 | 12/2010 | Eckert et al. |
| 7,862,820 B2 | 1/2011 | Peters et al. |
| 7,884,184 B2 | 2/2011 | DeGroot et al. |
| 7,906,490 B2 | 3/2011 | Kool |
| 7,943,168 B2 | 5/2011 | Schlesinger et al. |
| 7,943,581 B2 | 5/2011 | Divita et al. |
| 7,964,571 B2 | 6/2011 | Fewell et al. |
| 7,999,087 B2 | 8/2011 | Dellinger et al. |
| 8,003,129 B2 | 8/2011 | Hoffman et al. |
| 8,008,449 B2 | 8/2011 | Korman et al. |
| 8,039,214 B2 | 10/2011 | Dahl et al. |
| 8,048,999 B2 | 11/2011 | Yamanaka et al. |

(56) References Cited

U.S. PATENT DOCUMENTS

| | | |
|---|---|---|
| 8,057,821 B2 | 11/2011 | Slobodkin et al. |
| 8,058,069 B2 | 11/2011 | Yaworski et al. |
| 8,101,385 B2 | 1/2012 | Cload et al. |
| 8,105,596 B2 | 1/2012 | Goldenberg et al. |
| 8,108,385 B2 | 1/2012 | Kraft et al. |
| 8,137,911 B2 | 3/2012 | Dahl et al. |
| 8,153,768 B2 | 4/2012 | Kunz et al. |
| 8,158,360 B2 | 4/2012 | Heise et al. |
| 8,158,601 B2 | 4/2012 | Chen et al. |
| 8,178,660 B2 | 5/2012 | Weiner et al. |
| 8,183,345 B2 | 5/2012 | Fay et al. |
| 8,183,352 B2 | 5/2012 | Ayyavoo et al. |
| 8,202,983 B2 | 6/2012 | Dellinger et al. |
| 8,217,016 B2 | 7/2012 | Hoerr et al. |
| 8,226,950 B2 | 7/2012 | Lobb et al. |
| 8,242,081 B2 | 8/2012 | Divita et al. |
| 8,242,087 B2 | 8/2012 | Adelfinskaya et al. |
| 8,242,258 B2 | 8/2012 | Dellinger et al. |
| 8,246,958 B2 | 8/2012 | Bendig et al. |
| 8,278,036 B2 | 10/2012 | Kariko et al. |
| 8,304,183 B2 | 11/2012 | Sooknanan |
| 8,304,532 B2 | 11/2012 | Adamo et al. |
| 8,309,706 B2 | 11/2012 | Dellinger et al. |
| 8,329,172 B2 | 12/2012 | Grillo-Lopez et al. |
| 8,329,182 B2 | 12/2012 | Peters et al. |
| 8,329,887 B2 | 12/2012 | Dahl et al. |
| 8,333,799 B2 | 12/2012 | Bales, Jr. et al. |
| 8,344,153 B2 | 1/2013 | Cottrell et al. |
| 8,349,321 B2 | 1/2013 | Burke et al. |
| 8,367,328 B2 | 2/2013 | Asada et al. |
| 8,367,631 B2 | 2/2013 | Pitard |
| 8,383,340 B2 | 2/2013 | Ketterer et al. |
| 8,394,763 B2 | 3/2013 | Forte et al. |
| 8,399,007 B2 | 3/2013 | Taft et al. |
| 8,404,222 B2 | 3/2013 | Harris |
| 8,404,799 B2 | 3/2013 | Podobinski et al. |
| 8,414,927 B2 | 4/2013 | Richard |
| 8,415,325 B2 | 4/2013 | Kiick et al. |
| 8,420,123 B2 | 4/2013 | Troiano et al. |
| 8,420,605 B2 | 4/2013 | Ulijn et al. |
| 8,431,160 B2 | 4/2013 | O'Hagan et al. |
| 8,435,504 B2 | 5/2013 | Kozlowski et al. |
| 8,440,231 B2 | 5/2013 | Smyth et al. |
| 8,440,614 B2 | 5/2013 | Castor |
| 8,444,992 B2 | 5/2013 | Borkowski et al. |
| 8,449,884 B2 | 5/2013 | Rivera et al. |
| 8,449,916 B1 | 5/2013 | Bellaire et al. |
| 8,450,298 B2 | 5/2013 | Mahon et al. |
| 8,454,946 B2 | 6/2013 | Shen |
| 8,454,948 B2 | 6/2013 | Pearlman et al. |
| 8,460,696 B2 | 6/2013 | Slobodkin et al. |
| 8,460,709 B2 | 6/2013 | Ausborn et al. |
| 8,461,132 B2 | 6/2013 | Cohen et al. |
| 8,466,122 B2 | 6/2013 | Heyes et al. |
| 8,470,560 B2 | 6/2013 | Bergmann-Leitner et al. |
| 8,470,771 B2 | 6/2013 | Gao et al. |
| 8,476,234 B2 | 7/2013 | Fima et al. |
| 8,496,945 B2 | 7/2013 | Schlesinger et al. |
| 8,506,928 B2 | 8/2013 | Ferrara et al. |
| 8,506,966 B2 | 8/2013 | Podda et al. |
| 8,512,964 B2 | 8/2013 | Tontonoz et al. |
| 8,518,871 B2 | 8/2013 | Hsu et al. |
| 8,529,538 B2 | 9/2013 | Pang et al. |
| 8,529,939 B2 | 9/2013 | Masters et al. |
| 8,530,429 B2 | 9/2013 | Robbins et al. |
| 8,530,625 B2 | 9/2013 | Kaplan et al. |
| 8,535,655 B2 | 9/2013 | O'Shea et al. |
| 8,535,701 B2 | 9/2013 | Peery et al. |
| 8,535,702 B2 | 9/2013 | Richard et al. |
| 8,545,843 B2 | 10/2013 | Curd et al. |
| 8,557,231 B2 | 10/2013 | Langer et al. |
| 8,557,244 B1 | 10/2013 | White et al. |
| 8,562,992 B2 | 10/2013 | Adams et al. |
| 8,563,041 B2 | 10/2013 | Grayson et al. |
| 8,568,784 B2 | 10/2013 | Lillard et al. |
| 8,569,256 B2 | 10/2013 | Heyes et al. |
| 8,580,297 B2 | 11/2013 | Essler et al. |
| 8,603,499 B2 | 12/2013 | Zale et al. |
| 8,603,500 B2 | 12/2013 | Zale et al. |
| 8,603,501 B2 | 12/2013 | Zale et al. |
| 8,603,534 B2 | 12/2013 | Zale et al. |
| 8,603,535 B2 | 12/2013 | Troiano et al. |
| 8,609,142 B2 | 12/2013 | Troiano et al. |
| 8,609,822 B2 | 12/2013 | Elson et al. |
| 8,613,951 B2 | 12/2013 | Zale et al. |
| 8,613,954 B2 | 12/2013 | Zale et al. |
| 8,617,608 B2 | 12/2013 | Zale et al. |
| 8,618,240 B2 | 12/2013 | Podobinski et al. |
| 8,623,367 B2 | 1/2014 | Momm et al. |
| 8,628,801 B2 | 1/2014 | Garreta et al. |
| 8,636,696 B2 | 1/2014 | Ross et al. |
| 8,636,994 B2 | 1/2014 | Bossard et al. |
| 8,637,028 B2 | 1/2014 | Alexis et al. |
| 8,637,083 B2 | 1/2014 | Troiano et al. |
| 8,642,076 B2 | 2/2014 | Manoharan et al. |
| 8,652,487 B2 | 2/2014 | Maldonado |
| 8,652,528 B2 | 2/2014 | Troiano et al. |
| 8,658,211 B2 | 2/2014 | Rozema et al. |
| 8,658,733 B2 | 2/2014 | Jorgedal et al. |
| 8,663,599 B1 | 3/2014 | Sung et al. |
| 8,663,692 B1 | 3/2014 | Muller et al. |
| 8,663,700 B2 | 3/2014 | Troiano et al. |
| 8,664,194 B2 | 3/2014 | de Fougerolles et al. |
| 8,668,926 B1 | 3/2014 | Mousa et al. |
| 8,680,069 B2 | 3/2014 | de Fougerolles et al. |
| 8,685,368 B2 | 4/2014 | Reineke |
| 8,685,458 B2 | 4/2014 | Miller et al. |
| 8,691,223 B2 | 4/2014 | Van Den Brink et al. |
| 8,691,750 B2 | 4/2014 | Constien et al. |
| 8,691,785 B2 | 4/2014 | Teng et al. |
| 8,691,963 B2 | 4/2014 | Brahmbhatt et al. |
| 8,691,966 B2 | 4/2014 | Kariko et al. |
| 8,696,637 B2 | 4/2014 | Ross |
| 8,697,098 B2 | 4/2014 | Perumal et al. |
| 8,703,204 B2 | 4/2014 | Bloom et al. |
| 8,709,483 B2 | 4/2014 | Farokhzad et al. |
| 8,710,200 B2 | 4/2014 | Schrum et al. |
| 8,715,677 B2 | 5/2014 | Bartlett et al. |
| 8,715,689 B2 | 5/2014 | Kinney et al. |
| 8,715,694 B2 | 5/2014 | Apt et al. |
| 8,715,736 B2 | 5/2014 | Sachdeva et al. |
| 8,715,741 B2 | 5/2014 | Maitra et al. |
| 8,716,465 B2 | 5/2014 | Rossi et al. |
| 8,722,341 B2 | 5/2014 | Fouchier et al. |
| 8,728,491 B2 | 5/2014 | Sesardic et al. |
| 8,728,527 B2 | 5/2014 | Singh |
| 8,728,772 B2 | 5/2014 | Suzuki et al. |
| 8,734,832 B2 | 5/2014 | O'hagan et al. |
| 8,734,846 B2 | 5/2014 | Ali et al. |
| 8,734,853 B2 | 5/2014 | Sood et al. |
| 8,735,566 B2 | 5/2014 | Brahmbhatt et al. |
| 8,735,570 B2 | 5/2014 | Miller et al. |
| 8,748,089 B2 | 6/2014 | Kariko et al. |
| 8,754,062 B2 | 6/2014 | de Fougerolles et al. |
| 8,802,438 B2 | 8/2014 | Rossi et al. |
| 8,808,982 B2 | 8/2014 | Dahl et al. |
| 8,822,663 B2 | 9/2014 | Schrum et al. |
| 8,835,108 B2 | 9/2014 | Kariko et al. |
| 8,846,348 B2 | 9/2014 | Jendrisak et al. |
| 8,853,179 B2 | 10/2014 | Mauro et al. |
| 8,853,377 B2 | 10/2014 | Guild et al. |
| 8,871,230 B2 | 10/2014 | Rudolph et al. |
| 8,883,506 B2 | 11/2014 | Rossi et al. |
| 8,999,380 B2 | 4/2015 | Bancel et al. |
| 2001/0001066 A1 | 5/2001 | Cezayirli et al. |
| 2001/0005506 A1 | 6/2001 | Cezayirli et al. |
| 2001/0014753 A1 | 8/2001 | Soloveichik et al. |
| 2002/0001842 A1 | 1/2002 | Chapman et al. |
| 2002/0064517 A1 | 5/2002 | Cederholm-Williams |
| 2002/0111471 A1 | 8/2002 | Lo et al. |
| 2002/0123099 A1 | 9/2002 | Weiner et al. |
| 2002/0123723 A1 | 9/2002 | Sorenson et al. |
| 2002/0127592 A1 | 9/2002 | Ichihara et al. |
| 2002/0130430 A1 | 9/2002 | Castor |

(56) References Cited

U.S. PATENT DOCUMENTS

| | | |
|---|---|---|
| 2002/0132788 A1 | 9/2002 | Lewis et al. |
| 2002/0143204 A1 | 10/2002 | Evain et al. |
| 2003/0026841 A1 | 2/2003 | Trubetskoy et al. |
| 2003/0032615 A1 | 2/2003 | Felgner et al. |
| 2003/0050468 A1 | 3/2003 | Shiver et al. |
| 2003/0073619 A1 | 4/2003 | Mahato et al. |
| 2003/0077604 A1 | 4/2003 | Sun et al. |
| 2003/0082768 A1 | 5/2003 | Baskerville et al. |
| 2003/0083272 A1 | 5/2003 | Wiederholt et al. |
| 2003/0138419 A1 | 7/2003 | Radic et al. |
| 2003/0143743 A1 | 7/2003 | Schuler et al. |
| 2003/0153735 A1 | 8/2003 | Breece et al. |
| 2003/0158133 A1 | 8/2003 | Movsesian |
| 2003/0170273 A1 | 9/2003 | O'Hagan et al. |
| 2003/0171253 A1 | 9/2003 | Ma et al. |
| 2003/0186237 A1 | 10/2003 | Ginsberg et al. |
| 2003/0191303 A1 | 10/2003 | Vinayak et al. |
| 2003/0192068 A1 | 10/2003 | DeBoer et al. |
| 2003/0225016 A1 | 12/2003 | Fearon et al. |
| 2004/0005667 A1 | 1/2004 | Ratti et al. |
| 2004/0018525 A1 | 1/2004 | Wirtz et al. |
| 2004/0106567 A1 | 6/2004 | Hagstrom et al. |
| 2004/0110191 A1 | 6/2004 | Winkler et al. |
| 2004/0122216 A1 | 6/2004 | Nielsen et al. |
| 2004/0142474 A1 | 7/2004 | Mahato et al. |
| 2004/0147027 A1 | 7/2004 | Troy et al. |
| 2004/0167090 A1 | 8/2004 | Monahan et al. |
| 2004/0171041 A1 | 9/2004 | Dahl et al. |
| 2004/0171980 A1 | 9/2004 | Mitragotri et al. |
| 2004/0197802 A1 | 10/2004 | Dahl et al. |
| 2004/0202658 A1 | 10/2004 | Benyunes |
| 2004/0209274 A2 | 10/2004 | Daly |
| 2004/0236268 A1 | 11/2004 | Mitragotri et al. |
| 2004/0259081 A1 | 12/2004 | Watzele et al. |
| 2005/0032730 A1 | 2/2005 | Von Der Mulbe et al. |
| 2005/0037494 A1 | 2/2005 | Hecker et al. |
| 2005/0054026 A1 | 3/2005 | Atsushi et al. |
| 2005/0059624 A1 | 3/2005 | Hoerr et al. |
| 2005/0064596 A1 | 3/2005 | Riemen et al. |
| 2005/0089913 A1 | 4/2005 | Williams |
| 2005/0112141 A1 | 5/2005 | Terman et al. |
| 2005/0130201 A1 | 6/2005 | Deras et al. |
| 2005/0137155 A1 | 6/2005 | McSwiggen et al. |
| 2005/0147618 A1 | 7/2005 | Rivera et al. |
| 2005/0153333 A1 | 7/2005 | Sooknanan |
| 2005/0181016 A1 | 8/2005 | Freyman et al. |
| 2005/0232919 A1 | 10/2005 | Grasso et al. |
| 2005/0250723 A1 | 11/2005 | Hoerr et al. |
| 2006/0008910 A1 | 1/2006 | MacLachlan et al. |
| 2006/0018971 A1 | 1/2006 | Scott et al. |
| 2006/0035226 A1 | 2/2006 | Scheinert et al. |
| 2006/0052584 A1* | 3/2006 | Tanaka et al. ............... 530/350 |
| 2006/0057111 A1 | 3/2006 | Hedlund et al. |
| 2006/0083780 A1 | 4/2006 | Heyes et al. |
| 2006/0160743 A1 | 7/2006 | Zhang et al. |
| 2006/0172003 A1 | 8/2006 | Meers et al. |
| 2006/0172966 A1 | 8/2006 | Lipford et al. |
| 2006/0188490 A1 | 8/2006 | Hoerr et al. |
| 2006/0204566 A1 | 9/2006 | Smyth-Templeton et al. |
| 2006/0241076 A1 | 10/2006 | Uhlmann et al. |
| 2006/0247195 A1 | 11/2006 | Ray |
| 2006/0265771 A1 | 11/2006 | Lewis et al. |
| 2006/0275747 A1 | 12/2006 | Hardy et al. |
| 2007/0037147 A1 | 2/2007 | Garcia et al. |
| 2007/0037148 A1 | 2/2007 | Fong et al. |
| 2007/0048741 A1 | 3/2007 | Getts et al. |
| 2007/0054278 A1 | 3/2007 | Cargill |
| 2007/0072175 A1 | 3/2007 | Cooper et al. |
| 2007/0087437 A1 | 4/2007 | Hu |
| 2007/0105124 A1 | 5/2007 | Getts et al. |
| 2007/0117112 A1 | 5/2007 | Diener et al. |
| 2007/0122882 A1 | 5/2007 | Nakagawa et al. |
| 2007/0141030 A1 | 6/2007 | Yu et al. |
| 2007/0143878 A1 | 6/2007 | Bhat et al. |
| 2007/0178103 A1 | 8/2007 | Fey et al. |
| 2007/0213287 A1 | 9/2007 | Fewell et al. |
| 2007/0224635 A1 | 9/2007 | Bouquin |
| 2007/0252295 A1 | 11/2007 | Panzner et al. |
| 2007/0265220 A1 | 11/2007 | Rossi et al. |
| 2007/0280929 A1 | 12/2007 | Hoerr et al. |
| 2008/0008711 A1 | 1/2008 | Schleyer et al. |
| 2008/0020431 A1 | 1/2008 | Getts et al. |
| 2008/0025944 A1 | 1/2008 | Hoerr et al. |
| 2008/0075698 A1 | 3/2008 | Sawada et al. |
| 2008/0076174 A1 | 3/2008 | Selden et al. |
| 2008/0119645 A1 | 5/2008 | Griffey et al. |
| 2008/0166414 A1 | 7/2008 | Hanes et al. |
| 2008/0166793 A1 | 7/2008 | Beer et al. |
| 2008/0171711 A1 | 7/2008 | Hoerr et al. |
| 2008/0220471 A1 | 9/2008 | Davis et al. |
| 2008/0260706 A1 | 10/2008 | Rabinovich et al. |
| 2008/0261905 A1 | 10/2008 | Herdewijn et al. |
| 2008/0267873 A1 | 10/2008 | Hoerr et al. |
| 2008/0274463 A1 | 11/2008 | Chen et al. |
| 2008/0275468 A1 | 11/2008 | Chuang et al. |
| 2008/0286813 A1 | 11/2008 | George-Hyslop et al. |
| 2008/0293143 A1 | 11/2008 | Lin et al. |
| 2009/0042825 A1 | 2/2009 | Matar et al. |
| 2009/0042829 A1 | 2/2009 | Matar et al. |
| 2009/0048167 A1 | 2/2009 | Hillman |
| 2009/0053775 A1 | 2/2009 | Dahl et al. |
| 2009/0093433 A1 | 4/2009 | Woolf et al. |
| 2009/0144839 A1 | 6/2009 | Inana et al. |
| 2009/0169550 A1 | 7/2009 | Dummer |
| 2009/0170090 A1 | 7/2009 | Ignatov et al. |
| 2009/0208418 A1 | 8/2009 | Kohler et al. |
| 2009/0208500 A1 | 8/2009 | Joly et al. |
| 2009/0226470 A1 | 9/2009 | Mauro et al. |
| 2009/0227660 A1 | 9/2009 | Oh et al. |
| 2009/0264511 A1 | 10/2009 | de Fougerolles et al. |
| 2009/0281298 A1 | 11/2009 | Manoharan et al. |
| 2009/0286852 A1 | 11/2009 | Kariko et al. |
| 2009/0324584 A1 | 12/2009 | Hoerr et al. |
| 2010/0003337 A1 | 1/2010 | Hanes et al. |
| 2010/0004313 A1 | 1/2010 | Slobodkin et al. |
| 2010/0004315 A1 | 1/2010 | Slobodkin et al. |
| 2010/0009424 A1 | 1/2010 | Forde et al. |
| 2010/0009865 A1 | 1/2010 | Herdewijn et al. |
| 2010/0015232 A1 | 1/2010 | Besenbacher et al. |
| 2010/0021429 A1 | 1/2010 | Brentzel, Jr. et al. |
| 2010/0028943 A1 | 2/2010 | Thomas et al. |
| 2010/0047261 A1 | 2/2010 | Hoerr et al. |
| 2010/0086922 A1 | 4/2010 | Bryant et al. |
| 2010/0120024 A1 | 5/2010 | Cload et al. |
| 2010/0129877 A1 | 5/2010 | Sahin et al. |
| 2010/0137407 A1 | 6/2010 | Abe et al. |
| 2010/0178271 A1 | 7/2010 | Bridger et al. |
| 2010/0189729 A1 | 7/2010 | Hoerr et al. |
| 2010/0196318 A1 | 8/2010 | Lieberburg |
| 2010/0203076 A1 | 8/2010 | Fotin-Mleczek et al. |
| 2010/0215580 A1 | 8/2010 | Hanes et al. |
| 2010/0233141 A1 | 9/2010 | Polach et al. |
| 2010/0239608 A1 | 9/2010 | Von Der Mulbe et al. |
| 2010/0258135 A1 | 10/2010 | Persson |
| 2010/0260817 A1 | 10/2010 | Slobodkin et al. |
| 2010/0261231 A1 | 10/2010 | Kore et al. |
| 2010/0266587 A1 | 10/2010 | McLachlan |
| 2010/0273220 A1 | 10/2010 | Yanik et al. |
| 2010/0285135 A1 | 11/2010 | Wendorf et al. |
| 2010/0291156 A1 | 11/2010 | Barner et al. |
| 2010/0293625 A1 | 11/2010 | Reed |
| 2010/0297750 A1 | 11/2010 | Natsume et al. |
| 2010/0305196 A1 | 12/2010 | Probst et al. |
| 2011/0002934 A1 | 1/2011 | Luqman et al. |
| 2011/0020352 A1 | 1/2011 | Garcia et al. |
| 2011/0045022 A1 | 2/2011 | Tsai |
| 2011/0053829 A1 | 3/2011 | Baumhof et al. |
| 2011/0065103 A1 | 3/2011 | Sahin et al. |
| 2011/0077287 A1 | 3/2011 | Von Der Mulbe et al. |
| 2011/0086904 A1 | 4/2011 | Russell |
| 2011/0091473 A1 | 4/2011 | Golab et al. |
| 2011/0091879 A1 | 4/2011 | Hillebrand et al. |
| 2011/0097716 A1 | 4/2011 | Natt et al. |
| 2011/0112040 A1 | 5/2011 | Liu et al. |

(56) References Cited

U.S. PATENT DOCUMENTS

| | | |
|---|---|---|
| 2011/0143397 A1 | 6/2011 | Kariko et al. |
| 2011/0143436 A1 | 6/2011 | Dahl et al. |
| 2011/0165123 A1 | 7/2011 | Hartmann et al. |
| 2011/0165159 A1 | 7/2011 | Grillo-Lopez et al. |
| 2011/0172126 A1 | 7/2011 | Brust |
| 2011/0182919 A1 | 7/2011 | Peters et al. |
| 2011/0200582 A1 | 8/2011 | Baryza et al. |
| 2011/0218231 A1 | 9/2011 | Fewell et al. |
| 2011/0244026 A1 | 10/2011 | Guild et al. |
| 2011/0245756 A1 | 10/2011 | Arora et al. |
| 2011/0247090 A1 | 10/2011 | Reed |
| 2011/0250225 A1 | 10/2011 | Fotin-Mleczek et al. |
| 2011/0250237 A1 | 10/2011 | O'Hagan |
| 2011/0269950 A1 | 11/2011 | Von Der Mulbe et al. |
| 2011/0274697 A1 | 11/2011 | Thomas et al. |
| 2011/0275793 A1 | 11/2011 | Debart et al. |
| 2011/0287006 A1 | 11/2011 | Friess et al. |
| 2011/0294717 A1 | 12/2011 | Ali et al. |
| 2011/0300205 A1 | 12/2011 | Geall et al. |
| 2011/0311472 A1 | 12/2011 | Hoerr et al. |
| 2012/0009145 A1 | 1/2012 | Slobodkin et al. |
| 2012/0009221 A1 | 1/2012 | Hoerr et al. |
| 2012/0009649 A1 | 1/2012 | Dahl et al. |
| 2012/0015899 A1 | 1/2012 | Lomonossoff et al. |
| 2012/0021043 A1 | 1/2012 | Kramps et al. |
| 2012/0027813 A1 | 2/2012 | Podda et al. |
| 2012/0046346 A1 | 2/2012 | Rossi et al. |
| 2012/0053333 A1 | 3/2012 | Mauro et al. |
| 2012/0060293 A1 | 3/2012 | Stelter et al. |
| 2012/0065252 A1 | 3/2012 | Schrum et al. |
| 2012/0076836 A1 | 3/2012 | Hori et al. |
| 2012/0094906 A1 | 4/2012 | Guyon et al. |
| 2012/0095077 A1 | 4/2012 | Burrows et al. |
| 2012/0114686 A1 | 5/2012 | Schneewind et al. |
| 2012/0121718 A1 | 5/2012 | Lai et al. |
| 2012/0128699 A1 | 5/2012 | Kandimalla et al. |
| 2012/0129759 A1 | 5/2012 | Liu et al. |
| 2012/0156251 A1 | 6/2012 | Brito et al. |
| 2012/0156679 A1 | 6/2012 | Dahl et al. |
| 2012/0171290 A1 | 7/2012 | Coursaget et al. |
| 2012/0177724 A1 | 7/2012 | Irvine et al. |
| 2012/0178702 A1 | 7/2012 | Huang et al. |
| 2012/0189700 A1 | 7/2012 | Aguilar et al. |
| 2012/0195917 A1 | 8/2012 | Sahin et al. |
| 2012/0195936 A1 | 8/2012 | Rudolph et al. |
| 2012/0207840 A1 | 8/2012 | de los Pinos |
| 2012/0213818 A1 | 8/2012 | Hoerr et al. |
| 2012/0219573 A1 | 8/2012 | Baumhof et al. |
| 2012/0225070 A1 | 9/2012 | Smith et al. |
| 2012/0232133 A1 | 9/2012 | Balazs et al. |
| 2012/0237975 A1 | 9/2012 | Schrum et al. |
| 2012/0251618 A1 | 10/2012 | Schrum et al. |
| 2012/0252117 A1 | 10/2012 | Selden et al. |
| 2012/0258046 A1 | 10/2012 | Mutzke |
| 2012/0276048 A1 | 11/2012 | Panzara et al. |
| 2012/0282247 A1 | 11/2012 | Schneewind et al. |
| 2012/0282249 A1 | 11/2012 | Fox et al. |
| 2012/0295832 A1 | 11/2012 | Constien et al. |
| 2012/0301955 A1 | 11/2012 | Thomas et al. |
| 2012/0321719 A1 | 12/2012 | McDonnell et al. |
| 2012/0322864 A1 | 12/2012 | Rossi et al. |
| 2012/0322865 A1 | 12/2012 | Rossi et al. |
| 2013/0012426 A1 | 1/2013 | de los Pinos |
| 2013/0012450 A1 | 1/2013 | de los Pinos |
| 2013/0012566 A1 | 1/2013 | De Los Pinos |
| 2013/0017223 A1 | 1/2013 | Hope et al. |
| 2013/0017265 A1 | 1/2013 | Farokhzad et al. |
| 2013/0022538 A1 | 1/2013 | Rossi |
| 2013/0029418 A1 | 1/2013 | Angel et al. |
| 2013/0059360 A1 | 3/2013 | Bossard et al. |
| 2013/0064894 A1 | 3/2013 | Martin et al. |
| 2013/0065942 A1 | 3/2013 | Matar et al. |
| 2013/0071450 A1 | 3/2013 | Copp-Howland |
| 2013/0072670 A1 | 3/2013 | Srivastava et al. |
| 2013/0072709 A1 | 3/2013 | McManus et al. |
| 2013/0084289 A1 | 4/2013 | Curd et al. |
| 2013/0090287 A1 | 4/2013 | Alessi et al. |
| 2013/0090372 A1 | 4/2013 | Budzik et al. |
| 2013/0102034 A1 | 4/2013 | Schrum |
| 2013/0102545 A1 | 4/2013 | Gao et al. |
| 2013/0108629 A1 | 5/2013 | Dumont et al. |
| 2013/0111615 A1 | 5/2013 | Kariko et al. |
| 2013/0115192 A1 | 5/2013 | Ali et al. |
| 2013/0115196 A1 | 5/2013 | Hantash et al. |
| 2013/0115247 A1 | 5/2013 | de los Pinos |
| 2013/0115272 A1 | 5/2013 | de Fougerolles et al. |
| 2013/0115273 A1 | 5/2013 | Yang et al. |
| 2013/0115274 A1 | 5/2013 | Knopov et al. |
| 2013/0115293 A1 | 5/2013 | Sabnis et al. |
| 2013/0116307 A1 | 5/2013 | Heyes et al. |
| 2013/0116408 A1 | 5/2013 | de los Pinos |
| 2013/0121954 A1 | 5/2013 | Wakefield et al. |
| 2013/0121988 A1 | 5/2013 | Hoerr et al. |
| 2013/0122104 A1 | 5/2013 | Yaworski et al. |
| 2013/0123338 A1 | 5/2013 | Heyes et al. |
| 2013/0123351 A1 | 5/2013 | Dewitt |
| 2013/0123481 A1 | 5/2013 | de Fougerolles et al. |
| 2013/0129627 A1 | 5/2013 | Delehanty et al. |
| 2013/0129726 A1 | 5/2013 | Lee |
| 2013/0129785 A1 | 5/2013 | Manoharan et al. |
| 2013/0129794 A1 | 5/2013 | Kleiner et al. |
| 2013/0129830 A1 | 5/2013 | Chen et al. |
| 2013/0130348 A1 | 5/2013 | Gu et al. |
| 2013/0133483 A1 | 5/2013 | Yang et al. |
| 2013/0136746 A1 | 5/2013 | Schneewind |
| 2013/0137644 A1 | 5/2013 | Alluis et al. |
| 2013/0138032 A1 | 5/2013 | Kim et al. |
| 2013/0142818 A1 | 6/2013 | Baumhof et al. |
| 2013/0142868 A1 | 6/2013 | Hoekman et al. |
| 2013/0142876 A1 | 6/2013 | Howard et al. |
| 2013/0149318 A1 | 6/2013 | Reynolds et al. |
| 2013/0149375 A1 | 6/2013 | Geall |
| 2013/0149783 A1 | 6/2013 | Yockman et al. |
| 2013/0150295 A1 | 6/2013 | Jaworowicz |
| 2013/0150625 A1 | 6/2013 | Budzik et al. |
| 2013/0150822 A1 | 6/2013 | Ross |
| 2013/0156721 A1 | 6/2013 | Cheng et al. |
| 2013/0156776 A1 | 6/2013 | Chang et al. |
| 2013/0156845 A1 | 6/2013 | Manoharan et al. |
| 2013/0156849 A1 | 6/2013 | de Fougerolles et al. |
| 2013/0164219 A1 | 6/2013 | Brinkmann et al. |
| 2013/0164343 A1 | 6/2013 | Hanes et al. |
| 2013/0164348 A1 | 6/2013 | Palasis et al. |
| 2013/0164400 A1 | 6/2013 | Knopov et al. |
| 2013/0165499 A1 | 6/2013 | Vaishnaw et al. |
| 2013/0165504 A1 | 6/2013 | Bancel et al. |
| 2013/0165772 A1 | 6/2013 | Traverso et al. |
| 2013/0171138 A1 | 7/2013 | Peters et al. |
| 2013/0171175 A1 | 7/2013 | Pierce et al. |
| 2013/0171183 A1 | 7/2013 | Schneewind |
| 2013/0171241 A1 | 7/2013 | Geall |
| 2013/0171646 A1 | 7/2013 | Park et al. |
| 2013/0172406 A1 | 7/2013 | Zale et al. |
| 2013/0172600 A1 | 7/2013 | Chang et al. |
| 2013/0177499 A1 | 7/2013 | Brahmbhatt et al. |
| 2013/0177523 A1 | 7/2013 | Ghandehari et al. |
| 2013/0177587 A1 | 7/2013 | Robinson et al. |
| 2013/0177611 A1 | 7/2013 | Kaplan et al. |
| 2013/0177633 A1 | 7/2013 | Schutt et al. |
| 2013/0177634 A1 | 7/2013 | Schutt et al. |
| 2013/0177635 A1 | 7/2013 | Schutt et al. |
| 2013/0177636 A1 | 7/2013 | Schutt et al. |
| 2013/0177637 A1 | 7/2013 | Schutt et al. |
| 2013/0177638 A1 | 7/2013 | Schutt et al. |
| 2013/0177639 A1 | 7/2013 | Geall et al. |
| 2013/0177640 A1 | 7/2013 | Geall et al. |
| 2013/0178541 A1 | 7/2013 | Stanton et al. |
| 2013/0183244 A1 | 7/2013 | Hanes et al. |
| 2013/0183355 A1 | 7/2013 | Jain et al. |
| 2013/0183372 A1 | 7/2013 | Schutt et al. |
| 2013/0183373 A1 | 7/2013 | Schutt et al. |
| 2013/0183375 A1 | 7/2013 | Schutt et al. |
| 2013/0183718 A1 | 7/2013 | Rohayem et al. |
| 2013/0184207 A1 | 7/2013 | Fares et al. |

(56) References Cited

U.S. PATENT DOCUMENTS

| | | |
|---|---|---|
| 2013/0184443 A1 | 7/2013 | Bentley et al. |
| 2013/0184453 A1 | 7/2013 | Davis et al. |
| 2013/0189295 A1 | 7/2013 | Aric et al. |
| 2013/0189351 A1 | 7/2013 | Geall |
| 2013/0189741 A1 | 7/2013 | Meis et al. |
| 2013/0195759 A1 | 8/2013 | Mirkin et al. |
| 2013/0195765 A1 | 8/2013 | Gho et al. |
| 2013/0195846 A1 | 8/2013 | Friess et al. |
| 2013/0195898 A1 | 8/2013 | O'Hagan et al. |
| 2013/0195967 A1 | 8/2013 | Guild et al. |
| 2013/0195968 A1 | 8/2013 | Geall et al. |
| 2013/0195969 A1 | 8/2013 | Geall et al. |
| 2013/0197068 A1 | 8/2013 | Kariko et al. |
| 2013/0202595 A1 | 8/2013 | Peirce et al. |
| 2013/0202645 A1 | 8/2013 | Barner et al. |
| 2013/0202684 A1 | 8/2013 | Geall et al. |
| 2013/0203115 A1 | 8/2013 | Schrum et al. |
| 2013/0209454 A1 | 8/2013 | Diskin et al. |
| 2013/0209456 A1 | 8/2013 | Kano et al. |
| 2013/0236419 A1 | 9/2013 | Schneewind et al. |
| 2013/0236500 A1 | 9/2013 | Zale et al. |
| 2013/0236533 A1 | 9/2013 | Von Andrian et al. |
| 2013/0236550 A1 | 9/2013 | Ausborn et al. |
| 2013/0236556 A1 | 9/2013 | Lai et al. |
| 2013/0236968 A1 | 9/2013 | Manoharan et al. |
| 2013/0236974 A1 | 9/2013 | de Fougerolles et al. |
| 2013/0237592 A1 | 9/2013 | de Fougerolles et al. |
| 2013/0237593 A1 | 9/2013 | de Fougerolles et al. |
| 2013/0237594 A1 | 9/2013 | de Fougerolles et al. |
| 2013/0243747 A1 | 9/2013 | Fima et al. |
| 2013/0243827 A1 | 9/2013 | Troiano et al. |
| 2013/0243848 A1 | 9/2013 | Lobovkina et al. |
| 2013/0243867 A1 | 9/2013 | Mohapatra et al. |
| 2013/0244278 A1 | 9/2013 | de Fougerolles et al. |
| 2013/0244279 A1 | 9/2013 | de Fougerolles et al. |
| 2013/0244282 A1 | 9/2013 | Schrum et al. |
| 2013/0244972 A1 | 9/2013 | Ben-Shalom et al. |
| 2013/0245091 A1 | 9/2013 | Rozema et al. |
| 2013/0245103 A1 | 9/2013 | de Fougerolles et al. |
| 2013/0245106 A1 | 9/2013 | de Fougerolles et al. |
| 2013/0245107 A1 | 9/2013 | de Fougerolles et al. |
| 2013/0251679 A1 | 9/2013 | Pearlman et al. |
| 2013/0251766 A1 | 9/2013 | Zale et al. |
| 2013/0251816 A1 | 9/2013 | Zale et al. |
| 2013/0251817 A1 | 9/2013 | Zale et al. |
| 2013/0252281 A1 | 9/2013 | de Fougerolles et al. |
| 2013/0259923 A1 | 10/2013 | Bancel et al. |
| 2013/0259924 A1 | 10/2013 | Bancel et al. |
| 2013/0266553 A1 | 10/2013 | Ballance et al. |
| 2013/0266611 A1 | 10/2013 | Rabinovich et al. |
| 2013/0266617 A1 | 10/2013 | Mirosevich et al. |
| 2013/0266640 A1 | 10/2013 | de Fougerolles et al. |
| 2013/0272994 A1 | 10/2013 | Fu et al. |
| 2013/0273039 A1 | 10/2013 | Grillo-Lopez |
| 2013/0273047 A1 | 10/2013 | Rivera et al. |
| 2013/0273081 A1 | 10/2013 | Monaci et al. |
| 2013/0273104 A1 | 10/2013 | Podda et al. |
| 2013/0273109 A1 | 10/2013 | Settembre et al. |
| 2013/0273117 A1 | 10/2013 | Podobinski et al. |
| 2013/0274194 A1 | 10/2013 | Dumont et al. |
| 2013/0274504 A1 | 10/2013 | Colletti et al. |
| 2013/0274523 A1 | 10/2013 | Bawiec, III et al. |
| 2013/0280334 A1 | 10/2013 | Karp et al. |
| 2013/0280339 A1 | 10/2013 | Zale et al. |
| 2013/0281658 A1 | 10/2013 | Rozema et al. |
| 2013/0281671 A1 | 10/2013 | Peters et al. |
| 2013/0287832 A1 | 10/2013 | O'Hagan |
| 2013/0289093 A1 | 10/2013 | Bhat et al. |
| 2013/0295183 A1 | 11/2013 | Troiano et al. |
| 2013/0295191 A1 | 11/2013 | Troiano et al. |
| 2013/0302432 A1 | 11/2013 | Zale et al. |
| 2013/0302433 A1 | 11/2013 | Troiano et al. |
| 2013/0315831 A1 | 11/2013 | Shi et al. |
| 2013/0317079 A1 | 11/2013 | Wakefield et al. |
| 2013/0323179 A1 | 12/2013 | Popov et al. |
| 2013/0323310 A1 | 12/2013 | Smyth et al. |
| 2013/0330401 A1 | 12/2013 | Payne et al. |
| 2013/0338210 A1 | 12/2013 | Manoharan et al. |
| 2013/0344091 A1 | 12/2013 | Berger et al. |
| 2013/0344158 A1 | 12/2013 | Zale et al. |
| 2014/0004593 A1 | 1/2014 | Boldog et al. |
| 2014/0005379 A1 | 1/2014 | Gu |
| 2014/0010861 A1 | 1/2014 | Bancel et al. |
| 2014/0017327 A1 | 1/2014 | Cheng et al. |
| 2014/0017329 A1 | 1/2014 | Mousa |
| 2014/0030292 A1 | 1/2014 | Franti et al. |
| 2014/0030351 A1 | 1/2014 | Zale et al. |
| 2014/0037573 A1 | 2/2014 | Eliasof et al. |
| 2014/0037660 A1 | 2/2014 | Fotin-Mleczek et al. |
| 2014/0037714 A1 | 2/2014 | Quay et al. |
| 2014/0039032 A1 | 2/2014 | Kumboyama et al. |
| 2014/0044772 A1 | 2/2014 | MacLachlan et al. |
| 2014/0044791 A1 | 2/2014 | Basilion et al. |
| 2014/0045913 A1 | 2/2014 | Kumboyama et al. |
| 2014/0045950 A1 | 2/2014 | Lacko et al. |
| 2014/0050775 A1 | 2/2014 | Slobodkin et al. |
| 2014/0056867 A1 | 2/2014 | LeBowitz et al. |
| 2014/0056970 A1 | 2/2014 | Panzer et al. |
| 2014/0057109 A1 | 2/2014 | Mechen et al. |
| 2014/0065172 A1 | 3/2014 | Echeverri et al. |
| 2014/0065204 A1 | 3/2014 | Hayes et al. |
| 2014/0065228 A1 | 3/2014 | Yarowoski et al. |
| 2014/0066363 A1 | 3/2014 | Bhunia et al. |
| 2014/0073687 A1 | 3/2014 | Chien et al. |
| 2014/0073715 A1 | 3/2014 | Fonnum et al. |
| 2014/0073738 A1 | 3/2014 | Fonnum et al. |
| 2014/0079774 A1 | 3/2014 | Brinker et al. |
| 2014/0079776 A1 | 3/2014 | Lippard et al. |
| 2014/0080766 A1 | 3/2014 | Pirie et al. |
| 2014/0081012 A1 | 3/2014 | DeSimone et al. |
| 2014/0093575 A1 | 4/2014 | Hammond et al. |
| 2014/0093579 A1 | 4/2014 | Zale et al. |
| 2014/0100178 A1 | 4/2014 | Ansari et al. |
| 2014/0105930 A1 | 4/2014 | Springer |
| 2014/0105964 A1 | 4/2014 | Bancel et al. |
| 2014/0105965 A1 | 4/2014 | Bancel et al. |
| 2014/0105966 A1 | 4/2014 | Bancel et al. |
| 2014/0106260 A1 | 4/2014 | Cargnello et al. |
| 2014/0107189 A1 | 4/2014 | Bancel et al. |
| 2014/0107227 A1 | 4/2014 | Masters et al. |
| 2014/0107229 A1 | 4/2014 | Kormann et al. |
| 2014/0107349 A1 | 4/2014 | Bentley et al. |
| 2014/0107594 A1 | 4/2014 | Guo et al. |
| 2014/0113137 A1 | 4/2014 | Podobinski et al. |
| 2014/0113959 A1 | 4/2014 | Bancel et al. |
| 2014/0113960 A1 | 4/2014 | Bancel et al. |
| 2014/0121263 A1 | 5/2014 | Fitzgerald et al. |
| 2014/0121393 A1 | 5/2014 | Manoharan et al. |
| 2014/0121587 A1 | 5/2014 | Sallberg et al. |
| 2014/0127227 A1 | 5/2014 | Chang |
| 2014/0127301 A1 | 5/2014 | Alexis et al. |
| 2014/0128269 A1 | 5/2014 | Hinz et al. |
| 2014/0128329 A1 | 5/2014 | Gore et al. |
| 2014/0134129 A1 | 5/2014 | Thalhamer et al. |
| 2014/0134201 A1 | 5/2014 | Tureci et al. |
| 2014/0134230 A1 | 5/2014 | Frank et al. |
| 2014/0135380 A1 | 5/2014 | Hadwiger et al. |
| 2014/0135381 A1 | 5/2014 | Hadwiger et al. |
| 2014/0141025 A1 | 5/2014 | Kudirka et al. |
| 2014/0141037 A1 | 5/2014 | Swanson et al. |
| 2014/0141067 A1 | 5/2014 | Bancel et al. |
| 2014/0141068 A1 | 5/2014 | Bancel et al. |
| 2014/0141070 A1 | 5/2014 | Geall et al. |
| 2014/0141089 A1 | 5/2014 | Liang |
| 2014/0141483 A1 | 5/2014 | Bossard et al. |
| 2014/0142165 A1 | 5/2014 | Grayson et al. |
| 2014/0142254 A1 | 5/2014 | Fonnum et al. |
| 2014/0147432 A1 | 5/2014 | Bancel et al. |
| 2014/0147454 A1 | 5/2014 | Chakraborty et al. |
| 2014/0148502 A1 | 5/2014 | Bancel et al. |
| 2014/0148503 A1 | 5/2014 | Giangrande et al. |
| 2014/0155472 A1 | 6/2014 | Bancel et al. |
| 2014/0155473 A1 | 6/2014 | Bancel et al. |
| 2014/0155474 A1 | 6/2014 | Bancel et al. |

(56) References Cited

U.S. PATENT DOCUMENTS

| | | |
|---|---|---|
| 2014/0155475 A1 | 6/2014 | Bancel et al. |
| 2014/0161873 A1 | 6/2014 | Bancel et al. |
| 2014/0162934 A1 | 6/2014 | Constien et al. |
| 2014/0162962 A1 | 6/2014 | Constien et al. |
| 2014/0170175 A1 | 6/2014 | Constien et al. |
| 2014/0171485 A1 | 6/2014 | Bancel et al. |
| 2014/0178429 A1 | 6/2014 | Tsai |
| 2014/0178438 A1 | 6/2014 | Ugur et al. |
| 2014/0179771 A1 | 6/2014 | Bancel et al. |
| 2014/0186432 A1 | 7/2014 | Bancel et al. |
| 2014/0193482 A1 | 7/2014 | Bancel et al. |
| 2014/0193484 A1 | 7/2014 | Bertholet Girardin et al. |
| 2014/0194494 A1 | 7/2014 | Bancel et al. |
| 2014/0199371 A1 | 7/2014 | Bancel et al. |
| 2014/0200261 A1 | 7/2014 | Hoge et al. |
| 2014/0200262 A1 | 7/2014 | Bancel et al. |
| 2014/0200263 A1 | 7/2014 | Bancel et al. |
| 2014/0200264 A1 | 7/2014 | Bancel et al. |
| 2014/0206752 A1 | 7/2014 | Afeyan et al. |
| 2014/0206753 A1 | 7/2014 | Guild et al. |
| 2014/0206755 A1 | 7/2014 | Bancel et al. |
| 2014/0206852 A1 | 7/2014 | Hoge et al. |
| 2014/0212498 A1 | 7/2014 | Brito et al. |
| 2014/0212504 A1 | 7/2014 | Weers et al. |
| 2014/0220083 A1 | 8/2014 | Brito et al. |
| 2014/0221465 A1 | 8/2014 | Bancel et al. |
| 2014/0227237 A1 | 8/2014 | June et al. |
| 2014/0227300 A1 | 8/2014 | Chin et al. |
| 2014/0227346 A1 | 8/2014 | Geall et al. |
| 2014/0242152 A1 | 8/2014 | Geall et al. |
| 2014/0243399 A1 | 8/2014 | Schrum et al. |
| 2014/0248312 A1 | 9/2014 | Rappuoli et al. |
| 2014/0248314 A1 | 9/2014 | Swanson et al. |
| 2014/0249208 A1 | 9/2014 | Bancel et al. |
| 2014/0255467 A1 | 9/2014 | Bancel et al. |
| 2014/0255468 A1 | 9/2014 | Bancel et al. |
| 2014/0255472 A1 | 9/2014 | Geall et al. |
| 2014/0271829 A1 | 9/2014 | Lilja et al. |
| 2014/0275227 A1 | 9/2014 | Hoge et al. |
| 2014/0275229 A1 | 9/2014 | Bancel et al. |
| 2014/0288160 A1 | 9/2014 | Guild et al. |
| 2014/0294938 A1 | 10/2014 | Guild et al. |
| 2014/0294939 A1 | 10/2014 | Guild et al. |
| 2014/0294940 A1 | 10/2014 | Guild et al. |
| 2014/0308746 A1 | 10/2014 | Rossi et al. |
| 2014/0309277 A1 | 10/2014 | Baryza et al. |
| 2014/0315988 A1 | 10/2014 | Dahl et al. |
| 2014/0328825 A1 | 11/2014 | Meis et al. |
| 2014/0341995 A1 | 11/2014 | Rudolph et al. |
| 2014/0343129 A1 | 11/2014 | de Fougerolles et al. |
| 2014/0363876 A1 | 12/2014 | Jendrisak et al. |
| 2014/0370545 A1 | 12/2014 | Mauro et al. |
| 2014/0371302 A1 | 12/2014 | Afeyan et al. |
| 2014/0378538 A1 | 12/2014 | Bancel et al. |
| 2015/0004217 A1 | 1/2015 | Guild et al. |
| 2015/0005372 A1 | 1/2015 | Hoge et al. |
| 2015/0017206 A1 | 1/2015 | Rueckl et al. |
| 2015/0017211 A1 | 1/2015 | de Fougerolles et al. |
| 2015/0030576 A1 | 1/2015 | Bancel et al. |
| 2015/0038558 A1 | 2/2015 | Kariko et al. |
| 2015/0044277 A1 | 2/2015 | Bancel et al. |
| 2015/0050354 A1 | 2/2015 | Bouchon et al. |
| 2015/0051268 A1 | 2/2015 | Bancel et al. |
| 2015/0056253 A1 | 2/2015 | Bancel et al. |
| 2015/0064235 A1 | 3/2015 | Bancel et al. |
| 2015/0064236 A1 | 3/2015 | Bancel et al. |
| 2015/0064725 A1 | 3/2015 | Schrum et al. |
| 2015/0086614 A1 | 3/2015 | Bancel et al. |
| 2015/0111248 A1 | 4/2015 | Bancel et al. |

FOREIGN PATENT DOCUMENTS

| | | |
|---|---|---|
| CA | 2795695 | 10/2011 |
| EP | 0194809 | 3/1986 |
| EP | 0204401 | 12/1986 |
| EP | 0366400 | 10/1989 |
| EP | 0366400 | 5/1990 |
| EP | 0427073 | 5/1991 |
| EP | 0427074 | 5/1991 |
| EP | 0735144 B1 | 3/1996 |
| EP | 0726319 | 8/1996 |
| EP | 0737750 | 10/1996 |
| EP | 0771873 A3 | 7/1997 |
| EP | 0839912 | 5/1998 |
| EP | 0969862 | 1/2000 |
| EP | 1026253 | 8/2000 |
| EP | 1083232 B1 | 3/2001 |
| EP | 1404860 | 5/2002 |
| EP | 1224943 | 7/2002 |
| EP | 1361277 | 11/2003 |
| EP | 1393745 | 3/2004 |
| EP | 1083232 | 2/2005 |
| EP | 1301614 | 11/2006 |
| EP | 1873180 A1 | 1/2008 |
| EP | 1905844 A2 | 2/2008 |
| EP | 1964922 A1 | 3/2008 |
| EP | 2072618 | 6/2009 |
| EP | 1056873 | 3/2010 |
| EP | 2191840 | 6/2010 |
| EP | 2092064 | 9/2010 |
| EP | 2246422 | 11/2010 |
| EP | 1619254 | 12/2010 |
| EP | 2292771 | 3/2011 |
| EP | 2377938 | 10/2011 |
| EP | 2468290 A1 | 6/2012 |
| EP | 2476430 B1 | 7/2012 |
| EP | 2484770 | 8/2012 |
| EP | 1907590 | 9/2012 |
| EP | 2535419 | 12/2012 |
| EP | 2188379 | 1/2013 |
| EP | 2548960 | 1/2013 |
| EP | 2620161 | 7/2013 |
| EP | 2623121 | 7/2013 |
| EP | 2073848 | 8/2013 |
| EP | 2623121 | 8/2013 |
| EP | 2695608 A2 | 2/2014 |
| EP | 2160464 B1 | 5/2014 |
| EP | 2607379 B1 | 5/2014 |
| EP | 2732825 A1 | 5/2014 |
| WO | 89/07947 A1 | 3/1989 |
| WO | 8906700 | 7/1989 |
| WO | 8909622 A1 | 10/1989 |
| WO | 9011092 | 10/1990 |
| WO | 9201813 A1 | 2/1992 |
| WO | 92/16553 A1 | 10/1992 |
| WO | 9309236 | 5/1993 |
| WO | 9314778 | 8/1993 |
| WO | 9512665 | 5/1995 |
| WO | 9524485 | 9/1995 |
| WO | 9526204 | 10/1995 |
| WO | 9529697 A1 | 11/1995 |
| WO | 95/35375 A1 | 12/1995 |
| WO | 9533835 | 12/1995 |
| WO | 9617086 | 6/1996 |
| WO | 9711085 | 3/1997 |
| WO | 9712519 | 4/1997 |
| WO | 9730064 A1 | 8/1997 |
| WO | 9741210 | 11/1997 |
| WO | 9746680 | 12/1997 |
| WO | 9748370 | 12/1997 |
| WO | 9800547 | 1/1998 |
| WO | 9812207 | 3/1998 |
| WO | 9819710 A2 | 5/1998 |
| WO | 9834640 | 8/1998 |
| WO | 9847913 A2 | 10/1998 |
| WO | 9855495 | 12/1998 |
| WO | 99/06073 | 2/1999 |
| WO | 9914346 | 3/1999 |
| WO | 9920766 | 4/1999 |
| WO | 9920774 | 4/1999 |
| WO | 9933982 | 7/1999 |
| WO | 9942618 | 8/1999 |
| WO | 9943835 | 9/1999 |

(56) References Cited

FOREIGN PATENT DOCUMENTS

| | | |
|---|---|---|
| WO | 9952503 | 10/1999 |
| WO | 9954457 | 10/1999 |
| WO | 0026226 | 5/2000 |
| WO | 0027340 | 5/2000 |
| WO | 0029561 | 5/2000 |
| WO | 0039327 | 7/2000 |
| WO | 0050586 | 8/2000 |
| WO | 0075304 | 12/2000 |
| WO | 0075356 | 12/2000 |
| WO | 0100650 | 1/2001 |
| WO | 0104313 | 1/2001 |
| WO | 01/14424 A2 | 3/2001 |
| WO | 0121810 | 3/2001 |
| WO | 2011025566 | 7/2001 |
| WO | 0155306 | 8/2001 |
| WO | 01/78779 A2 | 10/2001 |
| WO | 0192523 | 12/2001 |
| WO | 0193902 | 12/2001 |
| WO | 0208435 | 1/2002 |
| WO | 0224873 | 3/2002 |
| WO | 0246477 | 6/2002 |
| WO | 02064799 | 8/2002 |
| WO | 02065093 | 8/2002 |
| WO | 02102839 | 12/2002 |
| WO | 03002604 | 1/2003 |
| WO | 03018798 | 3/2003 |
| WO | 03028656 | 4/2003 |
| WO | 03029401 | 4/2003 |
| WO | 03046578 | 6/2003 |
| WO | 03050258 | 6/2003 |
| WO | 03051923 | 6/2003 |
| WO | 03059194 | 7/2003 |
| WO | 03059381 | 7/2003 |
| WO | 03066649 | 8/2003 |
| WO | 03086280 | 10/2003 |
| WO | 03087815 | 10/2003 |
| WO | 03101401 | 12/2003 |
| WO | 2004005544 | 1/2004 |
| WO | 2004010106 | 1/2004 |
| WO | 2005017107 A2 | 2/2004 |
| WO | 2004035607 A2 | 4/2004 |
| WO | 2004037972 | 5/2004 |
| WO | 2004058159 | 7/2004 |
| WO | 2004065561 | 8/2004 |
| WO | 2004067728 | 8/2004 |
| WO | 2004085474 | 10/2004 |
| WO | 2004087868 | 10/2004 |
| WO | 2004092329 | 10/2004 |
| WO | 2005005622 | 1/2005 |
| WO | 2005009346 | 2/2005 |
| WO | 2005/044859 A2 | 5/2005 |
| WO | 2005040416 | 5/2005 |
| WO | 2005047536 | 5/2005 |
| WO | 2005/062967 A2 | 7/2005 |
| WO | 2005098433 | 10/2005 |
| WO | 2005103081 A2 | 11/2005 |
| WO | 2005011857 | 12/2005 |
| WO | 2005117557 | 12/2005 |
| WO | 2006008154 A1 | 1/2006 |
| WO | 2006/013107 A1 | 2/2006 |
| WO | 2006022712 | 3/2006 |
| WO | 2006044456 | 4/2006 |
| WO | 2006044503 | 4/2006 |
| WO | 2006044505 | 4/2006 |
| WO | 2006044682 | 4/2006 |
| WO | 2006046978 A2 | 5/2006 |
| WO | 2006058088 | 6/2006 |
| WO | 2006063249 | 6/2006 |
| WO | 2006065479 | 6/2006 |
| WO | 2006065480 | 6/2006 |
| WO | 2006071903 | 7/2006 |
| WO | 2006095259 | 9/2006 |
| WO | 2006110581 | 10/2006 |
| WO | 2006110585 | 10/2006 |
| WO | 2006110599 | 10/2006 |
| WO | 2007005645 | 1/2007 |
| WO | 2007024323 | 3/2007 |
| WO | 2007024708 | 3/2007 |
| WO | 2007064952 | 3/2007 |
| WO | 2007059782 A1 | 5/2007 |
| WO | 2007062495 | 6/2007 |
| WO | 2007067968 | 6/2007 |
| WO | 2007069068 A2 | 6/2007 |
| WO | 2007095976 A2 | 8/2007 |
| WO | 2007100699 | 9/2007 |
| WO | 2007100789 | 9/2007 |
| WO | 2007104537 | 9/2007 |
| WO | 2008/003319 A1 | 1/2008 |
| WO | 2008011519 | 1/2008 |
| WO | 2008/019371 A1 | 2/2008 |
| WO | 2008014979 | 2/2008 |
| WO | 2008014979 A2 | 2/2008 |
| WO | 2008022046 A2 | 2/2008 |
| WO | 2008042973 | 4/2008 |
| WO | 2008051245 | 5/2008 |
| WO | 2008052770 | 5/2008 |
| WO | 2008068631 | 6/2008 |
| WO | 2008078180 | 7/2008 |
| WO | 2008078180 A2 | 7/2008 |
| WO | 2008083949 | 7/2008 |
| WO | 2008083949 A2 | 7/2008 |
| WO | 2008091799 | 7/2008 |
| WO | 2008/096370 A2 | 8/2008 |
| WO | 2008107388 A1 | 9/2008 |
| WO | 2008115504 A2 | 9/2008 |
| WO | 2008/134724 A2 | 11/2008 |
| WO | 2008/143878 A2 | 11/2008 |
| WO | 2008140615 | 11/2008 |
| WO | 2008144365 | 11/2008 |
| WO | 2008151049 A2 | 12/2008 |
| WO | 2008151058 | 12/2008 |
| WO | 2008153705 | 12/2008 |
| WO | 2008157688 | 12/2008 |
| WO | 2009006438 | 1/2009 |
| WO | 2009015071 | 1/2009 |
| WO | 2009024599 | 2/2009 |
| WO | 2009030254 | 3/2009 |
| WO | 2009030254 A1 | 3/2009 |
| WO | 2009030481 | 3/2009 |
| WO | 2009042971 | 4/2009 |
| WO | 2009046738 | 4/2009 |
| WO | 2009046739 | 4/2009 |
| WO | 2009046974 | 4/2009 |
| WO | 2009046975 | 4/2009 |
| WO | 2009/068649 A2 | 6/2009 |
| WO | 2009077134 | 6/2009 |
| WO | 2009095226 | 8/2009 |
| WO | 2009101407 | 8/2009 |
| WO | 2009/113083 A1 | 9/2009 |
| WO | 2009/120927 A2 | 10/2009 |
| WO | 2009127060 | 10/2009 |
| WO | 2009127230 | 10/2009 |
| WO | 2009149253 | 12/2009 |
| WO | 2010009065 | 1/2010 |
| WO | 2010009277 | 1/2010 |
| WO | 2010027903 | 3/2010 |
| WO | 2010033906 | 3/2010 |
| WO | 2010037408 | 4/2010 |
| WO | 2010037539 | 4/2010 |
| WO | 2010042490 | 4/2010 |
| WO | 2010042877 | 4/2010 |
| WO | 2010054406 | 5/2010 |
| WO | 2010/068918 A2 | 6/2010 |
| WO | 2010084371 A1 | 7/2010 |
| WO | 2010088537 | 8/2010 |
| WO | 2010088927 | 8/2010 |
| WO | 2010098861 | 9/2010 |
| WO | 2010111290 | 9/2010 |
| WO | 2010120266 | 10/2010 |
| WO | 2010129709 | 11/2010 |
| WO | 2010141135 | 12/2010 |
| WO | 2010144740 | 12/2010 |
| WO | 2011005341 A3 | 1/2011 |
| WO | 2011005799 | 1/2011 |

(56) References Cited

FOREIGN PATENT DOCUMENTS

| | | |
|---|---|---|
| WO | 2011/032633 A1 | 3/2011 |
| WO | 2011026641 | 3/2011 |
| WO | 2011026641 A9 | 3/2011 |
| WO | 2011062965 | 5/2011 |
| WO | 2011/069164 A2 | 6/2011 |
| WO | 2011068810 | 6/2011 |
| WO | 2011069528 | 6/2011 |
| WO | 2011069529 | 6/2011 |
| WO | 2011069586 | 6/2011 |
| WO | 2011069587 | 6/2011 |
| WO | 2011071931 | 6/2011 |
| WO | 2011071936 | 6/2011 |
| WO | 2011076807 | 6/2011 |
| WO | 2011088309 | 7/2011 |
| WO | 2011120053 | 9/2011 |
| WO | 2011127032 A1 | 10/2011 |
| WO | 2011127255 | 10/2011 |
| WO | 2011127933 A1 | 10/2011 |
| WO | 2011128444 | 10/2011 |
| WO | 2011130624 | 10/2011 |
| WO | 2011130624 A2 | 10/2011 |
| WO | 2011133868 A2 | 10/2011 |
| WO | 2011137206 | 11/2011 |
| WO | 2011144358 | 11/2011 |
| WO | 2011161653 | 12/2011 |
| WO | 2012003474 A2 | 1/2012 |
| WO | 2012006359 | 1/2012 |
| WO | 2012006369 | 1/2012 |
| WO | 2012006372 | 1/2012 |
| WO | 2012006376 | 1/2012 |
| WO | 2012006377 | 1/2012 |
| WO | 2012006378 | 1/2012 |
| WO | 2012006380 | 1/2012 |
| WO | 2012010855 | 1/2012 |
| WO | 2012013326 | 2/2012 |
| WO | 2012019168 | 2/2012 |
| WO | 2012019630 | 2/2012 |
| WO | 2012019780 | 2/2012 |
| WO | 2012023044 | 2/2012 |
| WO | 2012024526 | 2/2012 |
| WO | 2012030683 | 3/2012 |
| WO | 2012030901 | 3/2012 |
| WO | 2012030904 A2 | 3/2012 |
| WO | 2012031043 | 3/2012 |
| WO | 2012031046 | 3/2012 |
| WO | 2012034067 A1 | 3/2012 |
| WO | 2012034077 A2 | 3/2012 |
| WO | 2012045075 | 4/2012 |
| WO | 2012045082 | 4/2012 |
| WO | 2012050975 A2 | 4/2012 |
| WO | 2012064429 | 5/2012 |
| WO | 2012065164 | 5/2012 |
| WO | 2012068295 | 5/2012 |
| WO | 2012068360 | 5/2012 |
| WO | 2012068470 | 5/2012 |
| WO | 2012072269 | 6/2012 |
| WO | 2012075040 | 6/2012 |
| WO | 2012088381 | 6/2012 |
| WO | 2012089225 | 7/2012 |
| WO | 2012089338 | 7/2012 |
| WO | 2012094304 | 7/2012 |
| WO | 2012094574 | 7/2012 |
| WO | 2012099755 | 7/2012 |
| WO | 2012099805 | 7/2012 |
| WO | 2012103985 | 8/2012 |
| WO | 2012110636 A2 | 8/2012 |
| WO | 2012112582 | 8/2012 |
| WO | 2012113413 | 8/2012 |
| WO | 2012113513 | 8/2012 |
| WO | 2012116714 | 9/2012 |
| WO | 2012116715 | 9/2012 |
| WO | 2012116810 | 9/2012 |
| WO | 2012116811 | 9/2012 |
| WO | 2012117377 | 9/2012 |
| WO | 2012122318 | 9/2012 |
| WO | 2012125680 | 9/2012 |
| WO | 2012125812 | 9/2012 |
| WO | 2012125987 | 9/2012 |
| WO | 2012129483 | 9/2012 |
| WO | 2012131594 | 10/2012 |
| WO | 2012135025 | 10/2012 |
| WO | 2012135805 | 10/2012 |
| WO | 2012135805 A2 | 10/2012 |
| WO | 2012138453 A1 | 10/2012 |
| WO | 2012138530 A1 | 10/2012 |
| WO | 2012142240 | 10/2012 |
| WO | 2012143407 | 10/2012 |
| WO | 2012/149045 A2 | 11/2012 |
| WO | 2012/149252 A2 | 11/2012 |
| WO | 2012/149255 A2 | 11/2012 |
| WO | 2012/149259 A1 | 11/2012 |
| WO | 2012/149265 A2 | 11/2012 |
| WO | 2012/149282 A2 | 11/2012 |
| WO | 2012/149301 A2 | 11/2012 |
| WO | 2012/149376 A2 | 11/2012 |
| WO | 2012/149393 A2 | 11/2012 |
| WO | 2012/152910 A1 | 11/2012 |
| WO | 2012/153297 A1 | 11/2012 |
| WO | 2012/153338 A2 | 11/2012 |
| WO | 2012149246 | 11/2012 |
| WO | 2012149536 A1 | 11/2012 |
| WO | 2012151234 | 11/2012 |
| WO | 2012154202 A1 | 11/2012 |
| WO | 2012158613 | 11/2012 |
| WO | 2012160177 | 11/2012 |
| WO | 2012/162174 A1 | 12/2012 |
| WO | 2012166241 | 12/2012 |
| WO | 2012166923 | 12/2012 |
| WO | 2012168259 | 12/2012 |
| WO | 2012168491 | 12/2012 |
| WO | 2012170607 | 12/2012 |
| WO | 2012170889 | 12/2012 |
| WO | 2012170930 | 12/2012 |
| WO | 2012172495 | 12/2012 |
| WO | 2012172521 | 12/2012 |
| WO | 2012177760 A1 | 12/2012 |
| WO | 2013/003887 A1 | 1/2013 |
| WO | 2013/006824 A2 | 1/2013 |
| WO | 2013003475 | 1/2013 |
| WO | 2013006437 | 1/2013 |
| WO | 2013006825 | 1/2013 |
| WO | 2013006834 | 1/2013 |
| WO | 2013006837 | 1/2013 |
| WO | 2013006838 | 1/2013 |
| WO | 2013006842 | 1/2013 |
| WO | 2013009717 | 1/2013 |
| WO | 2013009736 | 1/2013 |
| WO | 2013011325 | 1/2013 |
| WO | 2013012476 | 1/2013 |
| WO | 2013016460 | 1/2013 |
| WO | 2013019669 | 2/2013 |
| WO | 2013025834 A2 | 2/2013 |
| WO | 2013030778 | 3/2013 |
| WO | 2013032829 | 3/2013 |
| WO | 2013033438 | 3/2013 |
| WO | 2013033563 | 3/2013 |
| WO | 2013033620 | 3/2013 |
| WO | 2013038375 | 3/2013 |
| WO | 2013039857 | 3/2013 |
| WO | 2013039861 | 3/2013 |
| WO | 2013044219 | 3/2013 |
| WO | 2013045505 | 4/2013 |
| WO | 2013049234 | 4/2013 |
| WO | 2013049247 | 4/2013 |
| WO | 2013049328 | 4/2013 |
| WO | 2013052167 | 4/2013 |
| WO | 2013052523 | 4/2013 |
| WO | 2013054307 | 4/2013 |
| WO | 2013055331 | 4/2013 |
| WO | 2013055905 | 4/2013 |
| WO | 2013055971 | 4/2013 |
| WO | 2013056132 | 4/2013 |
| WO | 2013057687 | 4/2013 |
| WO | 2013057715 | 4/2013 |

(56) References Cited

FOREIGN PATENT DOCUMENTS

| | | |
|---|---|---|
| WO | 2013059496 | 4/2013 |
| WO | 2013059509 | 4/2013 |
| WO | 2013/066866 A1 | 5/2013 |
| WO | 2013059922 | 5/2013 |
| WO | 2013061208 | 5/2013 |
| WO | 2013062140 | 5/2013 |
| WO | 2013063468 | 5/2013 |
| WO | 2013063530 | 5/2013 |
| WO | 2013064911 | 5/2013 |
| WO | 2013066274 | 5/2013 |
| WO | 2013066427 | 5/2013 |
| WO | 2013066903 | 5/2013 |
| WO | 2013067355 | 5/2013 |
| WO | 2013067530 | 5/2013 |
| WO | 2013067537 | 5/2013 |
| WO | 2013068413 | 5/2013 |
| WO | 2013068431 | 5/2013 |
| WO | 2013068432 | 5/2013 |
| WO | 2013068847 | 5/2013 |
| WO | 2013070653 | 5/2013 |
| WO | 2013070872 | 5/2013 |
| WO | 2013071047 | 5/2013 |
| WO | 2013072392 | 5/2013 |
| WO | 2013072929 | 5/2013 |
| WO | 2013074696 | 5/2013 |
| WO | 2013075068 | 5/2013 |
| WO | 2013077907 | 5/2013 |
| WO | 2013078199 | 5/2013 |
| WO | 2013/087911 A1 | 6/2013 |
| WO | 2013079604 | 6/2013 |
| WO | 2013082111 | 6/2013 |
| WO | 2013082418 | 6/2013 |
| WO | 2013082427 | 6/2013 |
| WO | 2013082470 | 6/2013 |
| WO | 2013082529 | 6/2013 |
| WO | 2013082590 | 6/2013 |
| WO | 2013084000 | 6/2013 |
| WO | 2013085951 | 6/2013 |
| WO | 2013086008 | 6/2013 |
| WO | 2013086322 | 6/2013 |
| WO | 2013086354 | 6/2013 |
| WO | 2013086373 | 6/2013 |
| WO | 2013086486 | 6/2013 |
| WO | 2013086502 | 6/2013 |
| WO | 2013086505 | 6/2013 |
| WO | 2013086526 | 6/2013 |
| WO | 2013087083 | 6/2013 |
| WO | 2013087791 | 6/2013 |
| WO | 2013087912 A1 | 6/2013 |
| WO | 2013088250 | 6/2013 |
| WO | 2013090294 | 6/2013 |
| WO | 2013090601 | 6/2013 |
| WO | 2013090648 | 6/2013 |
| WO | 2013090841 | 6/2013 |
| WO | 2013090861 | 6/2013 |
| WO | 2013090897 | 6/2013 |
| WO | 2013091001 | 6/2013 |
| WO | 2013093648 | 6/2013 |
| WO | 2013096626 | 6/2013 |
| WO | 2013096812 A1 | 6/2013 |
| WO | 2013098589 | 7/2013 |
| WO | 2013103842 | 7/2013 |
| WO | 2013112778 | 8/2013 |
| WO | 2013112780 | 8/2013 |
| WO | 2013113326 | 8/2013 |
| WO | 2013113501 | 8/2013 |
| WO | 2013113502 | 8/2013 |
| WO | 2013113736 | 8/2013 |
| WO | 2013128027 | 9/2013 |
| WO | 2013130161 | 9/2013 |
| WO | 2013130535 | 9/2013 |
| WO | 2013135359 | 9/2013 |
| WO | 2013136234 | 9/2013 |
| WO | 2013138343 | 9/2013 |
| WO | 2013138346 | 9/2013 |
| WO | 2013142349 A1 | 9/2013 |
| WO | 2013/151666 A2 | 10/2013 |
| WO | 2013143555 | 10/2013 |
| WO | 2013143683 | 10/2013 |
| WO | 2013143698 | 10/2013 |
| WO | 2013143699 | 10/2013 |
| WO | 2013143700 | 10/2013 |
| WO | 2013148186 | 10/2013 |
| WO | 2013148541 | 10/2013 |
| WO | 2013149141 | 10/2013 |
| WO | 2013151650 | 10/2013 |
| WO | 2013151663 A1 | 10/2013 |
| WO | 2013151664 A1 | 10/2013 |
| WO | 2013151665 A2 | 10/2013 |
| WO | 2013151667 A1 | 10/2013 |
| WO | 2013151668 A2 | 10/2013 |
| WO | 2013151669 | 10/2013 |
| WO | 2013151669 A1 | 10/2013 |
| WO | 2013151670 A2 | 10/2013 |
| WO | 2013151671 A1 | 10/2013 |
| WO | 2013151672 | 10/2013 |
| WO | 2013151672 A2 | 10/2013 |
| WO | 2013151736 A2 | 10/2013 |
| WO | 2013151771 | 10/2013 |
| WO | 2013152351 | 10/2013 |
| WO | 2013153550 | 10/2013 |
| WO | 2013154766 | 10/2013 |
| WO | 2013154774 | 10/2013 |
| WO | 2013155487 | 10/2013 |
| WO | 2013155493 | 10/2013 |
| WO | 2013155513 | 10/2013 |
| WO | 2013158127 | 10/2013 |
| WO | 2013158141 | 10/2013 |
| WO | 2013158579 | 10/2013 |
| WO | 2013/177421 A2 | 11/2013 |
| WO | 2013166385 | 11/2013 |
| WO | 2013166498 | 11/2013 |
| WO | 2013173582 A1 | 11/2013 |
| WO | 2013173657 | 11/2013 |
| WO | 2013173693 | 11/2013 |
| WO | 2013174409 | 11/2013 |
| WO | 2013182683 | 12/2013 |
| WO | 2013184945 | 12/2013 |
| WO | 2013185069 | 12/2013 |
| WO | 2013188979 | 12/2013 |
| WO | 2014004436 A2 | 1/2014 |
| WO | 2014012479 A1 | 1/2014 |
| WO | 2014012994 | 1/2014 |
| WO | 2014012996 | 1/2014 |
| WO | 2014014613 | 1/2014 |
| WO | 2014014890 A1 | 1/2014 |
| WO | 2014015334 | 1/2014 |
| WO | 2014015422 | 1/2014 |
| WO | 2014016439 | 1/2014 |
| WO | 2014018675 | 1/2014 |
| WO | 2014024193 | 2/2014 |
| WO | 2014025312 | 2/2014 |
| WO | 2014025795 | 2/2014 |
| WO | 2014025890 | 2/2014 |
| WO | 2014026044 | 2/2014 |
| WO | 2014026284 | 2/2014 |
| WO | 2014027006 | 2/2014 |
| WO | 2014028209 | 2/2014 |
| WO | 2014028429 A2 | 2/2014 |
| WO | 2014028487 | 2/2014 |
| WO | 2014028763 | 2/2014 |
| WO | 2014/039185 A1 | 3/2014 |
| WO | 2014/042920 A1 | 3/2014 |
| WO | 2014/043618 A1 | 3/2014 |
| WO | 2014/047649 A1 | 3/2014 |
| WO | 2014/052634 A1 | 4/2014 |
| WO | 2014/053654 A1 | 4/2014 |
| WO | 2014/054026 A1 | 4/2014 |
| WO | 2014/059022 A1 | 4/2014 |
| WO | 2014053622 A1 | 4/2014 |
| WO | 2014053624 A1 | 4/2014 |
| WO | 2014053628 A1 | 4/2014 |
| WO | 2014053629 A1 | 4/2014 |
| WO | 2014053634 A1 | 4/2014 |

(56) References Cited

FOREIGN PATENT DOCUMENTS

| | | |
|---|---|---|
| WO | 2014053879 A1 | 4/2014 |
| WO | 2014053880 A1 | 4/2014 |
| WO | 2014053881 A1 | 4/2014 |
| WO | 2014053882 A1 | 4/2014 |
| WO | 2014062697 A2 | 4/2014 |
| WO | 2014063059 A1 | 4/2014 |
| WO | 2014/064534 A2 | 5/2014 |
| WO | 2014/064543 A1 | 5/2014 |
| WO | 2014/066811 A1 | 5/2014 |
| WO | 2014/066898 A9 | 5/2014 |
| WO | 2014/066912 A1 | 5/2014 |
| WO | 2014/071072 A2 | 5/2014 |
| WO | 2014/072468 A1 | 5/2014 |
| WO | 2014/072747 A1 | 5/2014 |
| WO | 2014/072997 A1 | 5/2014 |
| WO | 2014/072999 A1 | 5/2014 |
| WO | 2014/074218 A1 | 5/2014 |
| WO | 2014/074299 A1 | 5/2014 |
| WO | 2014/074597 A1 | 5/2014 |
| WO | 2014064258 A1 | 5/2014 |
| WO | 2014064687 A1 | 5/2014 |
| WO | 2014067551 A1 | 5/2014 |
| WO | 2014068542 A1 | 5/2014 |
| WO | 2014071219 A1 | 5/2014 |
| WO | 2014071963 A1 | 5/2014 |
| WO | 2014072061 A1 | 5/2014 |
| WO | 2014072481 A1 | 5/2014 |
| WO | 2014074289 A1 | 5/2014 |
| WO | 2014074823 A1 | 5/2014 |
| WO | 2014074905 A1 | 5/2014 |
| WO | 2014074912 A1 | 5/2014 |
| WO | 2014075047 A2 | 5/2014 |
| WO | 2014076709 A1 | 5/2014 |
| WO | 2014078399 A1 | 5/2014 |
| WO | 2014078636 A1 | 5/2014 |
| WO | 2014081299 A1 | 5/2014 |
| WO | 2014081300 A1 | 5/2014 |
| WO | 2014081303 A1 | 5/2014 |
| WO | 2014081507 A1 | 5/2014 |
| WO | 2014081849 A1 | 5/2014 |
| WO | 2014093574 A1 | 6/2014 |
| WO | 2014093924 A1 | 6/2014 |
| WO | 2014144039 A1 | 9/2014 |
| WO | 2014144711 A1 | 9/2014 |
| WO | 2014144767 A1 | 9/2014 |
| WO | 2014152027 A1 | 9/2014 |
| WO | 2014152030 A1 | 9/2014 |
| WO | 2014152031 A1 | 9/2014 |
| WO | 2014152211 A1 | 9/2014 |
| WO | 2014152540 A1 | 9/2014 |
| WO | 2014158795 A1 | 10/2014 |
| WO | 2014159813 A1 | 10/2014 |
| WO | 2014164253 A1 | 10/2014 |
| WO | 2015006747 A2 | 1/2015 |
| WO | 2015034925 A1 | 3/2015 |
| WO | 2015034928 A1 | 3/2015 |
| WO | 2015038892 A1 | 3/2015 |
| WO | 2015048744 A2 | 4/2015 |
| WO | 2015051214 A1 | 4/2015 |
| WO | 2015058069 A1 | 4/2015 |

OTHER PUBLICATIONS

Kormann, M. et al. Expression of therapeutic proteins after delivery of chemically modified mRNA in mice. Nat Biotechnol. Feb. 2011;29(2):154-7.

Egeter, O. et al. Eradication of disseminated lymphomas with CpG-DNA activated T helper type 1 cells from nontransgenic mice. Cancer Res. Mar. 15, 2000;60(6):1515-20.

El Ouahabi, A., et al., Double long-chain amidine liposome-mediated self replicating RNA transfection. FEBS Letters. Feb. 1996; 380(1-2): 108-112.

Elango, N., et al., Optimized transfection of mRNA transcribed from a d(A/T)100 tail-containing vector. Biochem Biophys Res Commun. 2005; 330: 958-966.

Elbashir, S.M. et al., Duplexes of 21-nucleotide RNAs mediate RNA interference in cultured mammalian cells. Nature. May 24, 2001;411(6836):494-8.

Ellem, K.A.O., and Colter, J.S. The isolation of three variants of mengo virus differing in plaque morphology and hemagglutinating characteristics. Virology. Nov. 1961; 15(3): 340-347.

Ellem, K.A.O., and Colter, J.S. The interaction of infectious ribonucleic acid with a mammalian cell line: I. Relationship between the osmotic pressure of the medium and the production of infectious centers. Virology. Jun. 1960; 11(2): 434-443.

Ellem, K.A.O. and Colter, J.S. The interaction of infectious ribonucleic acid with a mammalian cell line: II. Kinetics of the formation of infectious centers. Virology. Dec. 1960; 12(4): 511-520.

Ellem, K.A.O. and Colter, J.S. The interaction of infectious ribonucleic acids with mammalian cells: III. Comparison of infection and RNA uptake in the HeLa cell-polio RNA and L cell-mengo RNA systems. Virology. Oct. 1961; 15(2): 113-126.

Epicentre Forum. Tools and Techniques for Genomics and RNA Research. 2006; 13(2): 1-8.

Epicentre Forum. Tools and Techniques for Genomics and RNA Research. 2007; 14(1): 1-24.

Esposito, S., Effect on Leukaemic Cells of Ribonucleic Acid Extracted from Calf's Spleen. Nature. Sep. 1964; 203: 1078-1079.

Esvelt, K., et al., A system for the continuous directed evolution of biomolecules. Nature. Apr. 2011; 472(7344): 499-503.

Fahy, E. et al., Self-sustained sequence replication (3SR): an isothermal transcription-based amplification system alternative to PCR. PCR Methods Appl. Aug. 1991;1(1):25-33.

Faissner, A. et al., Analysis of polypeptides of the tree shrew (*Tupaia*) herpesvirus by gel electrophoresis. J Gen Virol. Jan. 1982;58 Pt 1:139-48.

Fan, X.C., et al., Overexpression of HuR, a nuclear-cytoplasmic shuttling protein, increases the in vivo stability of ARE-containing mRNAs. Embo J. 1998; 17(12): 3448-3460.

Fandrich, F. et al., Preimplantation-stage stem cells induce long term allogeneic graft acceptance without supplementary host conditioning. Nat Med. Feb. 2002;8(2):171-8.

Fang, S.H. et al., Functional measurement of hepatitis C virus core-specific CD8(+) T-cell responses in the livers or peripheral blood of patients by using autologous peripheral blood mononuclear cells as targets or stimulators. J Clin Microbiol. Nov. 2001;39(11):3895-901.

Fearnley, D.B. et al., Monitoring human blood dendritic cell numbers in normal individuals and in stem cell transplantation. Blood. Jan. 15, 1999;93(2):728-36.

Felgner, P.L., et al., Lipofection: a highly efficient, lipid-mediated DNA-transfection procedure. Proc Natl Acad Sci U S A. Nov. 1987;84(21):7413-7.

Felgner, P.L. Particulate systems and polymers for in vitro and in vivo delivery of polynucleotides. Adv. Drug Delivery Rev. 1990; 5(3): 163-187.

Felgner, P.L. Cationic lipid/polynucleotide condensates for in vitro and in vivo polynucleotide delivery—the cytofectins. J. of Liposome Research. 1993; 3(1): 3-16.

Fisch, P. et al., Generation of antigen-presenting cells for soluble protein antigens ex vivo from peripheral blood CD34+ hematopoietic progenitor cells in cancer patients. Eur J Immunol. Mar. 1996;26(3):595-600.

Fisher, K.J. and Wilson, J.M. The transmembrane domain of diphtheria toxin improves molecular conjugate gene transfer. Biochem. J. Jan. 1997; 321(1): 49-58.

Fishman, M., et al., In vitro transfer of macrophage RNA to lymph node cells. Nature. May 11, 1963;198:549-51.

Fisk, B. et al., Identification of an immunodominant peptide of HER-2/neu protooncogene recognized by ovarian tumor-specific cytotoxic T lymphocyte lines. J Exp Med. Jun. 1, 1995;181(6):2109-17.

Frank, B. et al., Interanimal "memory" transfer: results from brain and liver homogenates. Science. Jul. 24, 1970;169(3943):399-402.

Franklin, R.M., Purification and properties of the replicative intermediate of the RNA bacteriophage R17. Proc Natl Acad Sci U S A. Jun. 1966;55(6):1504-11.

Frey, M.R. et al., RNA-mediated interaction of Cajal bodies and U2 snRNA genes. J Cell Biol. Aug. 6, 2001;154(3):499-509.

(56) References Cited

OTHER PUBLICATIONS

Fukuda, I. et al., In vitro evolution of single-chain antibodies using mRNA display. Nucleic Acids Res. 2006;34(19):e127. Epub Sep. 29, 2006.
Fusaki, N., et al., Efficient induction of transgene-free human pluripotent stem cells using a vector based on Sendai virus, an RNA virus that does not integrate into the host genome. Proc Jpn Acad Ser B Phys Biol Sci. 2009;85(8): 348-362.
Fynan E.F. et al., DNA vaccines: protective immunizations by parenteral, mucosal, and gene-gun inoculations. Proc Natl Acad Sci U S A. Dec. 15, 1993;90(24):11478-82.
Gall, J.G. et al., A role for Cajal bodies in assembly of the nuclear transcription machinery. FEBS Lett. Jun. 8, 2001;498(2-3):164-7.
Gall, J.G. The centennial of the Cajal body. Nat Rev Mol Cell Biol. Dec. 2003;4(12):975-80.
Gallie, D.R., A tale of two termini: a functional interaction between the termini of an mRNA is a prerequisite for efficient translation initiation. Gene. Aug. 17, 1998;216(1):1-11.
Gallie, D.R., The cap and poly(A) tail function synergistically to regulate mRNA translational efficiency. Genes Dev. Nov. 1991;5(11):2108-16.
Ganot, P. et al., Site-specific pseudouridine formation in preribosomal RNA is guided by small nucleolar RNAs. Cell. May 30, 1997;89(5):799-809.
Gao, M. et al., A novel mRNA-decapping activity in HeLa cytoplasmic extracts is regulated by AU-rich elements. EMBO J. Mar. 1, 2001;20(5):1134-43.
Gao, X. et al., Nonviral gene delivery: what we know and what is next. AAPS J. Mar. 23, 2007;9(1):E92-104.
Garbe, C. et al., [Epidemiology of malignant melanoma in West Germany in an international comparison]. Onkologie. Dec. 1989;12(6):253-62.
Gardiner-Garden, M. et al., CpG islands in vertebrate genomes. J Mol Biol. Jul. 20, 1987;196(2):261-82.
Gasche, C. et al., Sequential treatment of anemia in ulcerative colitis with intravenous iron and erythropoietin. Digestion. 1999;60(3):262-7.
GenBank NP_000651.3, Transforming growth factor beta-1 precursor [Homo sapiens]. Nov. 13, 2011; online.
Gerbi, S.A. et al., All small nuclear RNAs (snRNAs) of the [U4⁄U6.U5] Tri-snRNP localize to nucleoli; Identification of the nucleolar localization element of U6 snRNA. Mol Biol Cell. Sep. 2002;13(9):3123-37.
Gershon, P.D., (A)-tail of two polymerase structures. Nat Struct Biol. Oct. 2000;7(10):819-21.
Gierer, A and Schramm, G. Infectivity of ribonucleic acid from tobacco mosaic viurs. Nature. Apr. 1956; 177(4511):702-703.
Gilboa, E. et al., Cancer immunotherapy with mRNA-transfected dendritic cells. Immunol Rev. Jun. 2004;199:251-63.
Giljohann, D.A., et al., Gene regulation with polyvalent siRNA-nanoparticle conjugates. J Am Chem Soc. Feb. 2009;131(6): 2072-2073.
Gilkeson, G.S. et al., Induction of cross-reactive anti-dsDNA antibodies in preautoimmune NZB/NZW mice by immunization with bacterial DNA. J Clin Invest. Mar. 1995;95(3):1398-402.
Ginsberg, S.D. et al., Expression profile of transcripts in Alzheimer's disease tangle-bearing CA1 neurons. Ann Neurol. Jul. 2000;48(1):77-87.
Ginsberg, S.D. et al., Predominance of neuronal mRNAs in individual Alzheimer's disease senile plaques. Ann Neurol. Feb. 1999;45(2):174-81.
Biocca, S., et al., Intracellular expression of anti-p21ras single chain Fv fragments inhibits meiotic maturation of xenopus oocytes. Biochem Biophys Res Comm. Dec. 15, 1993; 197(2): 422-427.
Bird, A.P. et al., CpG-rich islands and the function of DNA methylation. Nature. May 15-21, 1986;321(6067):209-13.
Black, D.D. et al., Similarity of the transfer factors in Novikoff ascites tumor and other amino acid-incorporating systems. Cancer Res. May 1970;30(5):1281-6.
Bloch, G. et al., Sequence-dependence of the conformational changes induced by the 5-methyl cytosine in synthetic RNA oligomers. FEBS Lett. Jul. 27, 1987;219(2):464-8.
Boczkowski, D. et al., Dendritic cells pulsed with RNA are potent antigen-presenting cells in vitro and in vivo. J Exp Med. Aug. 1, 1996;184(2):465-72.
Boczkowski, D. et al., Induction of tumor immunity and cytotoxic T lymphocyte responses using dendritic cells transfected with messenger RNA amplified from tumor cells. Cancer Res. Feb. 15, 2000;60(4):1028-34.
Bonehill, A., et al., Single-step antigen loading and activation of dendritic cells by mRNA electroporation for the purpose of therapeutic vaccination in melanoma patients. Clin Cancer Res. May 2009; 15(10): 3366-3375.
Boon, T. et al., Genes coding for tumor rejection antigens: perspectives for specific immunotherapy. Important Adv Oncol. 1994:53-69.
Bose, S. et al., Role of nucleolin in human parainfluenza virus type 3 infection of human lung epithelial cells. J Virol. Aug. 2004;78(15):8146-58.
Bouxsein, N.F., et al., Structure and gene silencing activities of monovalent and pentavalent cationic lipid vectors complexed with siRNA\. Biochem. 2007; 46(16): 4785-4792.
Brandt, B. et al., Detection of the metastatic potential of blood-borne and immunomagnetically enriched epithelial cells by quantitative erbB-2 RT-PCR. Clin Exp Metastasis. Sep. 1996;14(4):399-408.
Brieba, L.G., et al., Role of T7 RNA polymerase His784 in start site selection and initial transcription. Biochem. 2002; 41: 5144-5149.
Brossart, P. et al., Her-2/neu-derived peptides are tumor-associated antigens expressed by human renal cell and colon carcinoma lines and are recognized by in vitro induced specific cytotoxic T lymphocytes. Cancer Res. Feb. 15, 1998;58(4):732-6.
Brossart, P. et al., Identification of HLA-A2-restricted T-cell epitopes derived from the MUC1 tumor antigen for broadly applicable vaccine therapies. Blood. Jun. 15, 1999;93(12):4309-17.
Brossart, P. et al., Induction of cytotoxic T-lymphocyte responses in vivo after vaccinations with peptide-pulsed dendritic cells. Blood. Nov. 1, 2000;96(9):3102-8.
Brossart, P. et al., Virus-mediated delivery of antigenic epitopes into dendritic cells as a means to induce CTL. J Immunol. Apr. 1, 1997;158(7):3270-6.
Buccoliero, R. et al., Elevation of lung surfactant phosphatidylcholine in mouse models of Sandhoff and of Niemann-Pick A disease. J Inherit Metab Dis. 2004;27(5):641-8.
Burke, B. et al., Microinjection of mRNA coding for an anti-Golgi antibody inhibits intracellular transport of a viral membrane protein. Cell. Apr. 1984;36(4):847-56.
Burks, E.A. et al, In vitro scanning saturation mutagenesis of an antibody binding pocket. Proc Natl Acad Sci U S A. Jan. 21, 1997;94(2):412-7.
Butler, E.T. et al., Bacteriophage SP6-specific RNA polymerase. I. Isolation and characterization of the enzyme. J Biol Chem. May 25, 1982;257(10):5772-8.
Cannon, G. et al., RNA based vaccines. DNA Cell Biol. Dec. 2002;21(12):953-61.
Capoccia, B.J., et al., G-CSF and AMD3100 mobilize monocytes into the blood that stimulate angiogenesis in vivo through a paracrine mechanism. Blood. Oct. 1, 2006; 108(7): 2438-2445.
Caput, D. et al., Identification of a common nucleotide sequence in the 3'-untranslated region of mRNA molecules specifying inflammatory mediators. Proc Natl Acad Sci U S A. Mar. 1986;83(6):1670-4.
Caron, H. et al., The human transcriptome map: clustering of highly expressed genes in chromosomal domains. Science. Feb. 16, 2001;291(5507):1289-92.
Carralot, J.P. et al., Polarization of immunity induced by direct injection of naked sequence-stabilized mRNA vaccines. Cell Mol Life Sci. Sep. 2004;61(18):2418-24.
Carralot, J.P. et al., Production and characterization of amplified tumor-derived cRNA libraries to be used as vaccines against metastatic melanomas. Genet Vaccines Ther. Aug. 22, 2005;3:6.
Caudy, A.A. et al., Fragile X-related protein and VIG associate with the RNA interference machinery. Genes Dev. Oct. 1, 2002;16(19):2491-6.

(56) References Cited

OTHER PUBLICATIONS

Cavaille, J. et al., Identification of brain-specific and imprinted small nucleolar RNA genes exhibiting an unusual genomic organization. Proc Natl Acad Sci U S A. Dec. 19, 2000;97(26):14311-6.
Cavaille, J. et al., Targeted ribose methylation of RNA in vivo directed by tailored antisense RNA guides. Nature. Nov. 24, 1996;383(6602):732-5.
Celluzzi, C.M. et al., Peptide-pulsed dendritic cells induce antigen-specific CTL-mediated protective tumor immunity. J Exp Med. Jan. 1, 1996;183(1):283-7.
Chan, E., et al., Live cell imaging distinguishes bona fide human iPS cells from partially reprogrammed cells. Nat Biotech. Nov. 2009: 27(11): 1033-1037.
Chappell, S.A. et al., Ribosomal tethering and clustering as mechanisms for translation initiation. Proc Natl Acad Sci U S A. Nov. 28, 2006;103(48):18077-82. Epub Nov. 16, 2006.
Charette, M. et al., Pseudouridine in RNA: what, where, how, and why. IUBMB Life. May 2000;49(5):341-51.
Chen, D., et al., Rapid discovery of potent siRNA-containing lipid nanoparticles enabled by controlled microfluidic formulation. J Am Chem Soc. 2012; 134: 6948-6951.
Chen, H., et al., TGF-beta 1 attenuates myocardial ischemia-reperfusion injury via inhibition of upregulation of MMP-1. Am J Physiol Heart Circ Physiol. May 2003; 284(5): H1612-7.
Chen, Z. et al., Enhanced protection against a lethal influenza virus challenge by immunization with both hemagglutinin- and neuraminidase-expressing DNAs. Vaccine. Feb. 26, 1999;17(7-8):653-9.
Cheng, C., et al., Multifunctional triblock copolymers for intracellular messenger RNA delivery. Biomaterials. Oct. 2012; 33(28): 6868-6876.
Cheng, W.F. et al., Enhancement of Sindbis virus self-replicating RNA vaccine potency by linkage of herpes simplex virus type 1 VP22 protein to antigen. J Virol. Mar. 2001;75(5):2368-76.
Cheng, W.F. et al., Enhancement of Sindbis virus self-replicating RNA vaccine potency by linkage of *Mycobacterium tuberculosis* heat shock protein 70 gene to an antigen gene. J Immunol. May 15, 2001;166(10):6218-26.
Cho, J.H. et al., Enhanced cellular immunity to hepatitis C virus nonstructural proteins by codelivery of granulocyte macrophage-colony stimulating factor gene in intramuscular DNA immunization. Vaccine. Mar. 5, 1999;17(9-10):1136-44.
Chui, H.M. et al., Synthesis of helix 69 of *Escherichia coli* 23S rRNA containing its natural modified nucleosides, m(3) Psi and Psi. J Org Chem. Dec. 13, 2002;67(25):8847-54.
Clawson, G.A. et al., Increased amounts of double-stranded RNA in the cytoplasm of rat liver following treatment with carcinogens. Cancer Res. Aug. 1982;42(8):3228-31.
Cohen, P.J. et al., Murine epidermal Langerhans cells and splenic dendritic cells present tumor-associated antigens to primed T cells. Eur J Immunol. Feb. 1994;24(2):315-9.
Collas, P. et al., Epigenetic reprogramming of nuclei using cell extracts. Stem Cell Rev. 2006;2(4):309-17.
Binder, R. et al., Evidence that the pathway of transferrin receptor mRNA degradation involves an endonucleolytic cleavage within the 3' UTR and does not involve poly(A) tail shortening. EMBO J. Apr. 15, 1994;13(8):1969-80.
Collas, P., Dedifferentiation of cells: new approaches. Cytotherapy. 2007;9(3):236-44.
Colter, J.S., et al., Infectivity of ribonucleic acid isolated from virus-infected tissues. Virology. 1957; 4(3): 522-532.
Colot, V. et al., Eukaryotic DNA methylation as an evolutionary device. Bioessays. May 1999;21(5):402-11.
Colter, J.S., et al., Infectivity of ribonucleic acid from Ehrlich Ascites tumour cells infected with Mengo Encephalitis. Nature. Apr. 1957; 179(4565): 859-860.
Condon, C. et al., DNA-based immunization by in vivo transfection of dendritic cells. Nat Med. Oct. 1996;2(10)1122-8.
US 2002/0198163, 12/2002, Felgner et al. (withdrawn).

Abuchowski, A. et al., Immunosuppressive properties and circulating life of Achromobacter glutaminase-asparaginase covalently attached to polyethylene glycol in man. Cancer Treat Rep. Nov.-Dec. 1981;65(11-12):1077-81.
Abuchowski, A. et al., Reduction of plasma urate levels in the cockerel with polyethylene glycol-uricase. J Pharmacol Exp Ther. Nov. 1981;219(2):352-4.
Aduri, R., et al., AMBER force field parameters for the naturally occurring modified nucleosides in RNA. J Chem Theory Comput. 2007; 3: 1464-1475.
Agaisse, H. et al., STAB-SD: a Shine-Dalgarno sequence in the 5' untranslated region is a determinant of mRNA stability. Mol Microbiol. May 1996;20(3):633-43.
Aissani, B. et al., CpG islands, genes and isochores in the genomes of vertebrates. Gene. Oct. 15, 1991;106(2):185-95.
Akashi, H., Gene expression and molecular evolution. Curr Opin Genet Dev. Dec. 2001;11(6):660-666.
Aksenova, N.N. et al., Influence of ribonucleic acids from the liver on implantation and growth of transplantable tumours. Nature. Nov. 3, 1962;196:443-4.
Alberts, et al., Molecular Biology of the Cell, 3rd ed. Garland Publishing, Inc. New York, NY, 1994, pp. 368-369.
Aleku, M., et al., Atu027, a liposomal small interfering RNA formulation targeting protein kinase N3, inhibits cancer progression. Cancer Res. 2008; 68: 9788-9798.
Anderson, B.R., et al., Nucleoside modifications in RNA limit activation of 2'-5'-oligoadenylate synthetase and increase resistance to cleavage by Rnase L Nucleic Acids Res. 2011; 1-10.
Anderson, D.M. et al., Stability of mRNA/cationic lipid lipoplexes in human and rat cerebrospinal fluid: methods and evidence for nonviral mRNA gene delivery to the central nervous system. Hum Gene Ther. Feb. 10, 2003;14(3):191-202.
Andrews-Pfannkoch, C. et al., Hydroxyapatite-mediated separation of double-stranded DNA, single-stranded DNA, and RNA genomes from natural viral assemblages. pl Environ Microbiol. Aug. 2010;76(15):5039-45. Epub Jun. 11, 2010.
Andries, O., et al., Comparison of the gene transfer efficiency of mRNA/GL67 and pDNA/GL67 complexes in respiratory cells. Mol Pharmaceutics. 2012; 9: 2136-2145.
Anichini, A. et al., Cytotoxic T cells directed to tumor antigens not expressed on normal melanocytes dominate HLA-A2.1-restricted immune repertoire to melanoma. J Immunol. Jan. 1, 1996;156(1):208-17.
Aota, S. et al., Diversity in G + C content at the third position of codons in vertebrate genes and its cause. Nucleic Acids Res. Aug. 26, 1986;14(16):6345-55.
Apostolopoulos, V. et al., Cellular mucins: targets for immunotherapy. Crit Rev Immunol. 1994;14(3-4):293-309.
Archer, S.J., Induction of a T-cell specific antigen on bone marrow lymphocytes with thymus RNA. Immunology. Jan. 1978;34(1):123-9.
Ashley, D.M. et al., Bone marrow-generated dendritic cells pulsed with tumor extracts or tumor RNA induce antitumor immunity against central nervous system tumors. J Exp Med. Oct. 6, 1997;186(7):1177-82.
Ast, G., How did alternative splicing evolve? Nat Rev Genet. Oct. 2004;5(10):773-82.
Aurup, H. et al., Translation of 2'-modified mRNA in vitro and in vivo. Nucleic Acids Res. Nov. 25, 1994;22(23):4963-8.
Austyn, J.M. et al., New insights into the mobilization and phagocytic activity of dendritic cells. J Exp Med. Apr. 1, 1996;183(4):1287-92.
Babich, F.R. et al., Cross-species transfer of learning: effect of ribonucleic acid from hamsters on rat behavior. Proc Natl Acad Sci U S A. Nov. 1965;54(5):1299-302.
Bachellerie, J.P. et al., Antisense snoRNAs: a family of nucleolar RNAs with long complementarities to rRNA. Trends Biochem Sci. Jul. 1995;20(7):261-4.
Bag, J., Recovery of normal protein synthesis in heat-shocked chicken myotubes by liposome-mediated transfer of mRNAs. Can. J. Biochem. Cell Biol. 1985; 63(3): 231-235.
Bagnall, et al., Rat strain differences on performance in the Morris water maze. Animal Technology, 1999, 50(2):69-77.

(56) References Cited

OTHER PUBLICATIONS

Baker, D.L. et al., RNA-guided RNA modification: functional organization of the archaeal H/ACA RNP. Genes Dev. May 15, 2005;19(10):1238-48. Epub May 3, 2005.
Bakker, J.M. et al, Therapeutic antibody gene transfer: an active approach to passive immunity. Mol Ther. Sep. 2004;10(3):411-6.
Balakin, A.G. et al., The RNA world of the nucleolus: two major families of small RNAs defined by different box elements with related functions. Cell. Sep. 6, 1996;86(5):823-34.
Bandbon Balenga, N.A. et al., Bicistronic expression plasmid encoding allergen and anti-IgE single chain variable fragment antibody as a novel DNA vaccine for allergy therapy and prevention. Med Hypotheses. 2006;67(1):71-4. Epub Mar. 2, 2006.
Banerjee, A.K., 5'-terminal cap structure in eucaryotic messenger ribonucleic acids. Microbiol Rev. Jun. 1980;44(2):175-205.
Barber, R., The chromatographic separation of ribonucleic acids. Biochim Biophys Acta. Feb. 21, 1966;114(2):422-4.
Bargmann, C.I. et al., The neu oncogene encodes an epidermal growth factor receptor-related protein. Nature. Jan. 16-22, 1986;319(6050):226-30.
Barlow, P.G., et al., The human cathelicidin LL-37 preferentially promotes apoptosis of infected airway epithelium. Am J Respir Cell Mol Biol. Dec. 2010; 43(6): 692-702.
Basarkar, A. et al., Nanoparticulate systems for polynucleotide delivery. Int J Nanomedicine. 2007; 2(3): 353-360.
Basha, G, et al., Influence of cationic lipid composition on gene silencing properties of lipid nanoparticle formulations of siRNA in antigen-presenting cells. Mol Ther. Dec. 2011; 19(12): 2186-2200.
Bechler, K., Influence of capping and polyadenylation on mRNA expression and on antisense RNA mediated inhibition of gene expression. Biochem Biophys Res Commun. Dec. 8, 1997;241(1):193-9.
Beljanski, et al., Iron stimulated RNA-dependent DNA polymerase activity from goldfish eggs. Cell Mol Biol. 1988;34(1):17-25.
Belliveau, N.M., et al., Microfluidic synthesis of highly potent limit-size lipid nanoparticles for in vivo delivery of siRNA. Mol Ther Nucleic Acids. Aug. 2012; 1(8): e37.
Bernardi, G. et al., The vertebrate genome: isochores and evolution. Mol Biol Evol. Jan. 1993;10(1):186-204.
Bernhard, H. et al., Generation of immunostimulatory dendritic cells from human CD34+ hematopoietic progenitor cells of the bone marrow and peripheral blood. Cancer Res. Mar. 1, 1995;55(5):1099-104.
Bernstein, E. et al., Role for a bidentate ribonuclease in the initiation step of RNA interference. Nature. Jan. 18, 2001;409(6818):363-6.
Bernstein, P. et al., Poly(A), poly(A) binding protein and the regulation of mRNA stability. Trends Biochem Sci. Sep. 1989;14(9):373-7.
Bertolini, M.C., et al., Fractionation of immune RNA isolated from the spleens of mice infected with Trypanosoma cruz. J Infect Dis. Jun. 1981;143(6):827-31.
Bertolini, In vitro effect of 18S immune RNA on macrophage resistance to Trypanosoma cruzi. Cell Mol Biol. 1986;32(2):167-71.
Bertolini, The protective effect of the 4-5S immune RNA against Trypanosoma cruzi infection in mice. Trop Med Parasitol. Sep. 1985;36(3):131-4.
Bertrand, E. et al., Assembly and traffic of small nuclear RNPs. Prog Mol Subcell Biol. 2004;35:79-97.
Bettinger, T. et al., Peptide-mediated RNA delivery: a novel approach for enhanced transfection of primary and post-mitotic cells. Nucleic Acids Res. Sep. 15, 2001;29(18):3882-91.
Bevan, M.J. et al., Antigen presentation to cytotoxic T lymphocytes in vivo. J Exp Med. Sep. 1, 1995;182(3):639-41.
Bevilacqua, A. et al., Post-transcriptional regulation of gene expression by degradation of messenger RNAs. J Cell Physiol. Jun. 2003;195(3):356-72.
Bieler, K. et al., Plasmids for Therapy and Vaccination. Wiley-VCH GmbH, Weinheim, Feb. 2001.
Conry, R.M. et al., Characterization of a messenger RNA polynucleotide vaccine vector. Cancer Res. Apr. 1, 1995;55(7):1397-1400.
Conry, R.M. et al., Immune response to a carcinoembryonic antigen polynucleotide vaccine. Cancer Res. Mar. 1, 1994;54(5):1164-8.
Conry, R.M. et al., A carcinoembryonic antigen polynucleotide vaccine has in vivo antitumor activity. Gene Ther. Jan. 1995;2(1):59-65.
Copreni, E. et al., Lentivirus-mediated gene transfer to the respiratory epithelium: a promising approach to gene therapy of cystic fibrosis. Gene Ther. Oct. 2004;11 Suppl 1:S67-75.
Cortes, J.J. et al., Mutations in the conserved loop of human U5 snRNA generate use of novel cryptic 5' splice sites in vivo. EMBO J. Dec. 15, 1993;12(13):5181-9.
Coughlin, C.M. et al., Targeting adult and pediatric cancers via cell-based vaccines and the prospect of activated B lymphocytes as a novel modality. Cancer Biol Ther. Sep.-Oct. 2003;2(5):466-70.
Cox, G.J. et al., Bovine herpesvirus 1: immune responses in mice and cattle injected with plasmid DNA. J Virol. Sep. 1993;67(9):5664-7.
Craig, J.M. et al., The distribution of CpG islands in mammalian chromosomes. Nat Genet. Jul. 1994;7(3):376-82.
Cramer, P. et al., Functional association between promoter structure and transcript alternative splicing. Proc Natl Acad Sci U S A. Oct. 14, 1997;94(21)11456-60.
Cree, B. et al., Tolerability and effects of rituxamab (anti CD20 antibody) in neuromyelitis optica (NMO) and rapidly worsening multiple sclerosis (MS). Neurology. 2004; 62(S5):A492.
Cuburu, N. et al., Intravaginal immunization with HPV vectors induces tissue-resident CD8+ T cell responses. J Clin Invest. Dec. 3, 2012; 122(12): 4606-4620.
Culver, K.W. et al., Gene Therapy, A Handbook for Physicians. Mary Ann Lieber, Inc, New York. 1994; 63-77.
Cunningham, S., et al., AAV2/8-mediated correction of OTC deficiency is robust in adult but not neonatal Spfash Mice. Mol Ther. Aug. 2009; 17(8): 1340-1346.
Daguer, J.P. et al., Increasing the stability of sacB transcript improves levansucrase production in Bacillus subtilis. Lett Appl Microbiol. 2005;41(2):221-6.
Dai, M.S. et at, Introduction of human erythropoietin receptor complementary DNA by retrovirus-mediated gene transfer into murine embryonic stem cells enhances erythropoiesis in developing embryoid bodies. Biol Blood Marrow Transplant. 2000;6(4):395-407.
Davidson, E.H., An Analysis of Niu Menchang's Research on Transformation by RNA. Biotechnology in China, 1989, 92-102.
Davis, H.L. et al., DNA-based immunization induces continuous secretion of hepatitis B surface antigen and high levels of circulating antibody. Hum Mol Genet. Nov. 1993;2(11):1847-51.
De Carvalho, S. et al., Biologic properties of human leukemic and tumoral RNA. IV. Leukemia and neoplasms induced in mice with human leukemic RNA carried in tissue culture. J Lab Clin Med. May 1960;55:706-14.
De Carvalho, S. et al., Comparative effects of liver and tumour ribonucleic acids on the normal liver and the Novikoff hepatoma cells of the rat. Nature. Mar. 11, 1961;189:815-7.
De Carvalho, S. et al., Differences in information content of ribonucleic acids from malignant tissues and homologous organs as expressed by their biological activities. Exp Mol Pathol. Apr. 1962;1:96-103.
De Carvalho, S., Angiokines, angiogenesis and angiolymphoproliferative syndromes (ALPS). Angiology. Apr. 1983;34(4):231-43.
De Carvalho, S., Biologic properties of human leukemic and tumoral RNA. III. The effect of different media on the cytopathogenicity in tissue culture. J Lab Clin Med. May 1960;55:694-705.
De Carvalho, S., Cancer 1974: an analytical vademecum of oncologic relevance. Oncology. 1973;28(4):289-98.
De Carvalho, S., Effect of RNA from normal human bone marrow on leukaemic marrow in vivo. Nature. Mar. 16, 1963;197:1077-80.
De Carvalho, S., Epigenetic transformation by RNA from human neoplastic cells. Oncology. 1973;27(1):3-29.
De Carvalho, S., in vitro angiogenic activity of RNA from leukemic lymphocytes. Angiology. Jul. 1978;29(7):497-505.
De Carvalho, S., Natural history of congenital leukemia. An experiment of nature revealing unexplored features of fetal-maternal isoimmunity, longest recorded survival following use of leukemostatic maternal isoantibody. Oncology. 1973;27(1):52-63.
De Lucca, F.L. et al., Effect of the calcium phosphate-mediated RNA uptake on the transfer of cellular immunity of a synthetic peptide of

(56) References Cited

OTHER PUBLICATIONS

HIV-1 to human lymphocytes by exogenous RNA. Mol Cell Biochem. Dec. 2001;228(1-2):9-14.
Delafontaine, P. et al., Regulation of vascular smooth muscle cell insulin-like growth factor I receptors by phosphorothioate oligonucleotides. Effects on cell growth and evidence that sense targeting at the ATG site increases receptor expression. J Biol Chem. Jun. 16, 1995;270(24):14383-8.
Deres, K. et al., in vivo priming of virus-specific cytotoxic T lymphocytes with synthetic lipopeptide vaccine. Nature. Nov. 30, 1989;342(6249):561-4.
Deshayes, S. et al., Cell-penetrating peptides: tools for intracellular delivery of therapeutics. Cell Mol Life Sci. Aug. 2005;62(16):1839-49.
Desrosiers, R. et al., Identification of methylated nucleosides in messenger RNA from Novikoff hepatoma cells. Proc Natl Acad Sci U S A. Oct. 1974;71(10):3971-5.
Diebold, S.S. et al., Innate antiviral responses by means of TLR7-mediated recognition of single-stranded RNA. Science. Mar. 5, 2004;303(5663)1529-31. Epub Feb. 19, 2004.
Dimari, J.F. et al., Initiation of mRNA decay in Bacillus subtilis. Mol Microbiol. Mar. 1993;7(5):705-17.
Ding, Z., et al., State-of-the-art 2003 on PKU gene therapy. Mol Genet Metab. Jan. 2004; 81(1): 3-8.
Dingman, W. et al., Molecular theories of memory. Science. Apr. 3, 1964;144(3614):26-9.
Disbrow, G.L. et al., Codon optimization of the HPV-16 E5 gene enhances protein expression. Virology. Jun. 20, 2003;311(1)105-14.
Dong, Y. et al., Poly(d,l-lactide-co-glycolide)/montmorillonite nanoparticles for oral delivery of anticancer drugs. Biomaterials. Oct. 2005;26(30):6068-76.
Donnelly, J. et al., Technical and regulatory hurdles for DNA vaccines. Int J Parasitol. May 2003;33(5-6):457-67.
Dubes, G.R. and Klingler, E.A. Jr. Facilitation of infection of monkey cells with poliovirus "ribonucleic acid." Science. Jan. 1961; 133(3446): 99-100.
Dunham, S.P. et al., The application of nucleic acid vaccines in veterinary medicine. Res Vet Sci. Aug. 2002;73(1):9-16.
Dunn, J.J. et al., Different template specificities of phage T3 and T7 RNA polymerases. Nat New Biol. Mar. 17, 1971;230(11):94-6.
Duret, L. et al., Expression pattern and, surprisingly, gene length shape codon usage in Caenorhabditis, *Drosophila*, and Arabidopsis. Proc Natl Acad Sci U S A. Apr. 13, 1999;96(8):4482-7.
Duret, L., Evolution of synonymous codon usage in metazoans. Curr Opin Genet Dev. Dec. 2002;12(6):640-9.
Earl, R.A., et al., A chemical synthesis of the nucleoside 1-Methylpseudouridine. A facile chemical synthesis of 1-methylpseudouridine has been accomplished by direct methylation of pseudouridine. J Heterocyclic Chem. Jun. 1977;14:699-700.
Easton, L.E. et al., Rapid, nondenaturing RNA purification using weak anion-exchange fast performance liquid chromatography. RNA. Mar. 2010;16(3):647-53. Epub Jan. 25, 2010.
Eberwine, J. et al., Analysis of gene expression in single live neurons. Proc Natl Acad Sci U S A. Apr. 1, 1992;89(7):3010-4.
Edelstein, M. L. et al., Gene therapy clinical trials worldwide 1989-2004—an overview. J Gene Med. Jun. 2004;6(6):597-602.
Edery, I. et al., An efficient strategy to isolate full-length cDNAs based on an mRNA cap retention procedure (CAPture). Mol Cell Biol. 1995; 15(6): 3363-3371.
Edmonds, M., Polyadenylate polymerases. Methods Enzymol. 1990;181:161-70.
Goldberg, I.H. et al., The incorporation of 5-ribosyluracil triphosphate into RNA in nuclear extracts of mammalian cells. Biochemical Biophysical Research Communications. 1961; 6(5): 394-398.
Goldberg, I.H. et al., Comparative utilization of pseudouridine triphosphate and uridine triphosphate by ribonucleic acid polymerase. J Biological Chem. May 1963; 238(5): 1793-1800.

Gordon, S.N. et al., Targeting the vaginal mucosa with human papillomavirus pseudovirion vaccines delivering SIV DNA. J Immunol. Jan. 15, 2012; 188(2): 714-723.
Grabbe, S. et al., Dendritic cells as initiators of tumor immune responses: a possible strategy for tumor immunotherapy? Immunol Today. Mar. 1995;16(3):117-21.
Grabbe, S. et al., Tumor antigen presentation by epidermal antigen-presenting cells in the mouse: modulation by granulocyte-macrophage colony-stimulating factor, tumor necrosis factor alpha, and ultraviolet radiation. J Leukoc Biol. Aug. 1992;52(2):209-17.
Grabbe, S. et al., Tumor antigen presentation by murine epidermal cells. J Immunol. May 15, 1991;146(10):3656-61.
Graf, M. et al., Codon-optimized genes that enable increased heterologous expression in mammalian cells and elicit efficient immune responses in mice after vaccination of naked DNA. Methods Mol Med. 2004;94:197-210.
Graham, F.L., et al., A new technique for the assay of infectivity of human adenovirus 5 DNA. Virology. Apr. 1973;52(2):456-67.
Gram, G.J. et al., Immunological analysis of a Lactococcus lactis-based DNA vaccine expressing HIV gp120. Genet Vaccines Ther. Jan. 29, 2007;5:3.
Granstein, R.D. et al., Induction of anti-tumor immunity with epidermal cells pulsed with tumor-derived RNA or intradermal administration of RNA. J Invest Dermatol. Apr. 2000;114(4):632-6.
Greenblatt, M.S. et al., Mutations in the p53 tumor suppressor gene: clues to cancer etiology and molecular pathogenesis. Cancer Res. Sep. 15, 1994;54(18):4855-78.
Grentzmann, G. et al., A dual-luciferase reporter system for studying recoding signals. RNA. Apr. 1998;4(4):479-86.
Grosjean, H., Modification and editing of RNA: historical overview and important facts to remember. Fine-tuning of RNA functions by modification and editing. Topics Curr Gen. Jan. 2005; 12: 1-22.
Gross, G. et al., Heterologous expression as a tool for gene identification and analysis. J Biol Chem. Jul. 31, 1995;41(2):91-110.
Grudzien, E. et al., Novel cap analogs for in vitro synthesis of mRNAs with high translational efficiency. RNA. Sep. 2004;10(9):1479-87.
Grudzien-Nogalska, E. et al., Phosphorothioate cap analogs stabilize mRNA and increase translational efficiency in mammalian cells RNA. Oct. 2007;13(10):1745-55. Epub Aug. 24, 2007.
Gryaznov, S.M., Oligonucleotide N3'→P5' phosphoramidates as potential therapeutic agents. Biochim Biophys Acta. Dec. 10, 1999;1489(1):131-40.
Guhaniyogi, J. et al., Regulation of mRNA stability in mammalian cells. Gene. Mar. 7, 2001;265(1-2):11-23.
Guo, L. et al., Structure and function of a cap-independent translation element that functions in either the 3' or the 5' untranslated region. RNA. Dec. 2000;6(12):1808-20.
Haas, J. et al., Codon usage limitation in the expression of HIV-1 envelope glycoprotein. Curr Biol. Mar. 1, 1996;6(3):315-24.
Hakelien, A.M., et al., Novel approaches to transdifferentiation. Cloning Stem Cells. 2002;4(4):379-87.
Hakelien, A.M., Reprogramming fibroblasts to express T-cell functions using cell extracts. Nat Biotechnol. May 2002;20(5):460-6.
Hambraeus, G. et al., A 5' stem-loop and ribosome binding but not translation are important for the stability of Bacillus subtilis aprE leader mRNA. Microbiology. Jun. 2002;148(Pt 6):1795-803.
Hancock, J.F., Reticulocyte lysate assay for in vitro translation and posttranslational modification of Ras proteins. Methods Enzymol. 1995;255:60-5.
Hannon, G.J. et al., Trans splicing of nematode pre-messenger RNA in vitro. Cell. Jun. 29, 1990;61(7):1247-55.
Harel, J., Action of polyribonucleotides, extracted by the phenol method, on the growth of mouse tumor cells. C.R. Hebd Seances Acad. Sci., 1962, 254:4390-2.
Harris, J. et al., An improved RNA amplification procedure results in increased yield of autologous RNA transfected dendritic cell-based vaccine. Biochim Biophys Acta. Jun. 20, 2005;1724(1-2):127-36. Epub Apr. 7, 2005.
Hausmann, R., Bacteriophage T7 genetics. Curr Top Microbiol Immunol. 1976;75:77-110.
Hays, E.F. et al., Induction of mouse leukaemia with purified nucleic acid preparations. Nature. Dec. 21, 1957;180(4599):1419-20.

(56) References Cited

OTHER PUBLICATIONS

He, K. et al., Synthesis and Separation of Diastereomers of Ribonucleoside 5'-(alpha-P-Borano)triphosphates. J Org Chem. Aug. 21, 1998;63(17):5769-5773.

Hecker, J.G. et al., Non-Viral DNA and mRNA Gene Delivery to the CNS Pre-Operatively for Neuroprotection and Following Neurotrauma. Molecular Therapy. 2004; 9, S258-S258.

Hedman, M, et al., Safety and feasibility of catheter-based local intracoronary vascular endothelial growth factor gene transfer in the prevention of postangioplasty and in-stent restenosis and in the treatment of chronic myocardial ischemia: phase II results of the Kuopio Angiogenesis Trial (KAT). Circulation. Jun. 3, 2003; 107(21): 2677-83. Epub May 12, 2003.

Heidenreich, O. et al., Chemically modified RNA: approaches and applications. FASEB J. Jan. 1993;7(1):90-6.

Heidenreich, O. et al., High activity and stability of hammerhead ribozymes containing 2'-modified pyrimidine nucleosides and phosphorothioates. J Biol Chem. Jan. 21, 1994;269(3):2131-8.

Heil, F. et al., Species-specific recognition of single-stranded RNA via toll-like receptor 7 and 8. Science. Mar. 5, 2004;303(5663):1526-9. Epub Feb. 19, 2004.

Heilman, K.L. et al., Internal 6-methyladenine residues increase the in vitro translation efficiency of dihydrofolate reductase messenger RNA. Int J Biochem Cell Biol. Jul. 1996; 28(7): 823-829.

Heiser, A. et al., Autologous dendritic cells transfected with prostate-specific antigen RNA stimulate CTL responses against metastatic prostate tumors. J Clin Invest. Feb. 2002;109(3):409-17.

Heiser, A. et al., Human dendritic cells transfected with renal tumor RNA stimulate polyclonal T-cell responses against antigens expressed by primary and metastatic tumors. Cancer Res. Apr. 15, 2001;61(8):3388-93.

Heiser, A. et al., Human dendritic cells transfected with RNA encoding prostate-specific antigen stimulate prostate-specific CTL responses in vitro. J Immunol. May 15, 2000;164(10):5508-14.

Heiser, A. et al., Induction of polyclonal prostate cancer-specific CTL using dendritic cells transfected with amplified tumor RNA. J Immunol. Mar. 1, 2001;166(5):2953-60.

Helbock, H.J. et al. N2-methyl-8-oxoguanine: a tRNA urinary metabolite—role of xanthine oxidase. Free Radic Biol Med. 1996;20(3):475-81.

Hemmi, H. et al, A Toll-like receptor recognizes bacterial DNA. Nature. Dec. 7, 2000;408(6813):740-5.

Herweijer, H. et al., Gene therapy progress and prospects: hydrodynamic gene delivery. Gene Ther. Jan. 2007;14 (2):99-107. Epub Nov. 30, 2006.

Hess, M. et al., The effects of nucleic acids on pituitary ACTH content. Endocrinology. Mar. 1961;68:548-52.

Higman, M.A. et al., The mRNA (guanine-7-)methyltransferase domain of the vaccinia virus mRNA capping enzyme. Expression in *Escherichia coli* and structural and kinetic comparison to the intact capping enzyme. J Biol Chem. May 27, 1994;269(21):14974-81.

Higman, M.A. et al., The vaccinia virus mRNA (guanine-N7-)-methyltransferase requires both subunits of the mRNA capping enzyme for activity. J Biol Chem. Aug. 15, 1992;267(23):16430-7.

Hilleren, P. et al., Mechanisms of mRNA surveillance in eukaryotes. Annu Rev Genet. 1999;33:229-60.

Hillman, N.W. et al., Chick Cephalogenesis, I. The Effect of RNA on Early Cephalic Development. PNAS, 1963, 50:486-93.

Ho, CS., et al., Electrospray ionisation mass spectrometry: Principles and clinical applications. Clin Biochem Rev. Feb. 2003; 24: 3-12.

Hoath, S.B. et al., The organization of human epidermis: functional epidermal units and phi proportionality. J Invest Dermatol. Dec. 2003;121(6):1440-6.

Kariko, K. et al., Incorporation of pseudouridine into mRNA yields superior nonimmunogenic vector with increased translational capacity and biological stability. Mol Ther. Nov. 2008;16(11):1833-40. Epub Sep. 16, 2008.

Kariko, K. et al., Phosphate-enhanced transfection of cationic lipid-complexed mRNA and plasmid DNA. Biochim Biophys Acta. Mar. 2, 1998;1369(2):320-34.

Kariko, K., et al., In vivo protein expression from mRNA delivered into adult rat brain. J. of Neuroscience Methods. Jan. 2001; 105(1): 77-86.

Kariko, K. et al., mRNA is an endogenous ligand for Toll-like receptor 3. J Biol Chem. Mar. 26, 2004;279(13):12542-50. Epub Jan. 16, 2004.

Kariko, K. et al., Suppression of RNA recognition by Toll-like receptors: the impact of nucleoside modification and the evolutionary origin of RNA. Immunity. Aug. 2005;23(2):165-75.

Kariko, K., et al., Increased erythropoiesis in mice injected with submicrogram quantities of pseudouridine-containing mRNA encoding erythropoietin. Mol Ther. May 2012; 20(5): 948-953.

Karlin, S. et al., Applications and statistics for multiple high-scoring segments in molecular sequences. Proc Nati Acad Sci U S A. Jun. 15, 1993;90(12):5873-7.

Katre, N.V. et al., Chemical modification of recombinant interleukin 2 by polyethylene glycol increases its potency in the murine Meth a sarcoma model. Proc Natl Acad Sci U S A. Mar. 1987;84(6):1487-91.

Katz, N., et al., Rapid onset of cutaneous anesthesia with EMLA cream after pretreatment with a new ultrasound-emitting device. Anesth Analg. 2004; 98: 371-376.

Kawai, T., et al., Antiviral signaling through pattern recognition receptors. J. Biochem. 2007; 141(2): 137-145.

Kawamura, T., et al., Linking the p53 tumor suppressor pathway to somatic cell reprogramming. Nature. Aug. 2009; 460(7259): 1140-1144.

Kazmierczak, K.M. et al., The phage N4 virion RNA polymerase catalytic domain is related to single-subunit RNA polymerases. EMBO J. Nov. 1, 2002;21(21):5815-23.

Keith, B., et al., HIF1a and HIF1a: sibling rivalry in hypoxic tumor growth and progression. Nat Rev Cancer. Jul. 2012; 12(1): 9-22.

Keller, E.B. et al., Intron splicing: a conserved internal signal in introns of animal pre-mRNAs. Proc Natl Acad Sci U S A. Dec. 1984;81(23):7417-20.

Keown, W.A., et al., [41] Methods for Introducing DNA into Mammalian Cells. Methods in Enzymology, 1990, 185:527-37.

Keshishian, H., et al., Quantification of cardiovascular biomarkers in patient plasma by targeted mass spectrometry and stable isotope dilution. Mol Cell Proteomics. Oct. 2009; 8(10): 2339-2349.

Kesselheim, A.S., An empirical review of major legislation affecting drug development: Past experiences, effects, and unintended consequences. The Milbank Quarterly. 2011; 89(3): 450-502.

Khare, P.D. et al., Tumor growth suppression by a retroviral vector displaying scFv antibody to CEA and carrying the iNOS gene. Anticancer Res. Jul.-Aug. 2002;22(4):2443-6.

Khullar, N. et al., Comparative evaluation of the protective effect of immune spleen cells and immune RNA against Plasmodium berghei. Ann. Trop. Med. Parasitol., 1988, 82(6):519-26.

Kim, C.H. et al., Codon optimization for high-level expression of human erythropoietin (EPO) in mammalian cells. Gene. Oct. 15, 1997;199(1-2):293-301.

Kim, D., et al., Generation of human induced pluripotent stem cells by direct delivery of reprogramming proteins. Cell Stem Cell Jun. 2009; 4(6): 472-476.

Kim, S.H., et al., Opsonized erythrocyte ghosts for liver-targeted delivery of antisense oligodeoxynucleotides. Biomaterials. Feb. 2009; 30(5): 959-967. Epub Nov. 22, 2008.

Kines, R.C. et al., The initial steps leading to papillomavirus infection occur on the basement membrane prior to cell surface binding. PNAS. Dec. 1, 2009; 106(48): 20458-20463.

Kinosita, K. Jr. et al., Formation and resealing of pores of controlled sizes in human erythrocyte membrane. Nature. Aug. 4, 1977;268(5619):438-41.

Kirby, K.S., A New Method for the Isolation of Ribonucleic Acids from Mammalian Tissues. J. Biochem., 1956, 64:405.

Kirshenbaum, et al., Designing polymers that mimic biomolecules. Curr Opin Struct Biol, 1999, 9:530-5.

Kirpotin, D.B., et al., Antibody targeting of long-circulating lipidic nanoparticles does not increase tumor localization but does increase internalization in animal models. Cancer Res. 2006; 66: 6732-6740.

Kiss, T., Small nucleolar RNA-guided post-transcriptional modification of cellular RNAs. EMBO J. Jul. 16, 2001;20(14):3617-22.

(56) References Cited

OTHER PUBLICATIONS

Kiss, T., Small nucleolar RNAs: an abundant group of noncoding RNAs with diverse cellular functions. Cell. Apr. 19, 2002;109(2):145-8.
Kitaguchi, K. et al., Immune deficiency enhances expression of recombinant human antibody in mice after nonviral in vivo gene transfer. Int J Mol Med. Oct. 2005;16(4):683-8.
Klinman, D.M. et al., DNA vaccines: safety and efficacy issues. Springer Semin Immunopathol. 1997;19(2):245-56.
Koch, G. and Bishop, J.M. The effect of polycations on the interaction of viral RNA with mammalian cells: Studies on the infectivity of single- and double-stranded poliovirus RNA. Virology. May 1968; 35(1): 9-17.
Koch, G., et al., Quantitative Studies on the Infectivity of ribonucleic acid from partially purified and highly purified poliovirus preparations. Virology. Mar. 1960; 10(3): 329-343.
Koch, G., et al., An agar cell-suspension plaque assay for isolated viral RNA. Biochem and Biophys Res Comm. 1966; 24(3): 304-309.
Kohler, G. et al., Continuous cultures of fused cells secreting antibody of predefined specificity. Nature. Aug. 7, 1975;256(5517):495-7.
Koide, Y. et al., DNA vaccines. Jpn J Pharmacol. Jul. 2000;83(3):167-74.
Koido, S. et al., Induction of antitumor immunity by vaccination of dendritic cells transfected with MUC1 RNA. J Immunol. Nov. 15, 2000;165(10):5713-9.
Kolb, A.F. et al., A virus-neutralising antibody is not cytotoxic in vitro. Mol Immunol. Feb. 2006;43(6):677-89.
Komar, A.A. et al., Synonymous codon substitutions affect ribosome traffic and protein folding during in vitro translation. FEBS Lett. Dec. 3, 1999;462(3):387-91.
Kontermann, R.E. et al., Recombinant bispecific antibodies for cancer therapy. Acta Pharmacol Sin. Jan. 2005;26(1):1-9.
Korsten, K.H. et al., The strategy of infection as a criterion for phylogenetic relationships of non-coli phages morphologically similar to phage T7. J Gen Virol. Apr. 1979;43(1):57-73.
Koski, G.K. et al., Cutting edge: innate immune system discriminates between RNA containing bacterial versus eukaryotic structural features that prime for high-level IL-12 secretion by dendritic cells. J Immunol. Apr. 1, 2004;172(7):3989-93.
Krieg, P.A. et al., Functional messenger RNAs are produced by SP6 in vitro transcription of cloned cDNAs. Nucleic Acids Res. Sep. 25, 1984;12(18):7057-70.
Krieg, P.A. et al., In vitro RNA synthesis with SP6 RNA polymerase. Methods Enzymol. 1987;155:397-415.
Kreiter, S., et al., Intranodal vaccination with naked antigen-encoding RNA elicits potent prophylactic and therapeutic antitumoral immunity. Cancer Res. 2010; 70: 9031-9040.
Kreiter, S., et al., Tumor vaccination using messenger RNA: prospects of a future therapy. Curr Opinion in Immun. Jun. 2011; 23(3): 399-406.
Kudla, G. et al., High guanine and cytosine content increases mRNA levels in mammalian cells. PLoS Biol. Jun. 2006;4(6):e180. Epub May 23, 2006.
Kufe, D.W. et al., Holland-Frei cancer medicine, 6th edition. Hamilton (ON): BC Decker; 2003; Table 12-1.
Kugler, A. et al., Regression of human metastatic renal cell carcinoma after vaccination with tumor cell-dendritic cell hybrids. Nat Med. Mar. 2000;6(3):332-6.
Kuhn, A.N., et al., mRNA as a versatile tool for exogenous protein expression. Current Gene Therapy. Oct. 2012; 12 (5): 347-361.
Kuhn, E., et al., Developing multiplexed assays for Troponin I and Interleukin-33 in plasma by peptide immunoaffinity enrichment and targeted mass spectrometry. Clinical Chem. 2009; 55(6): 1108-1117.
Kundu, T.K. et al., CpG islands in chromatin organization and gene expression. J Biochem. Feb. 1999;125(2):217-22.
Kusakabe, K. et al., The timing of GM-CSF expression plasmid administration influences the Th1/Th2 response induced by an HIV-1-specific DNA vaccine. J Immunol. Mar. 15, 2000;164(6):3102-11.

Kvasnica, M. et al., Platinum(ll) complexes with steroidal esters of L-methionine and L-histidine: synthesis, characterization and cytotoxic activity. Bioorg Med Chem. Apr. 1, 2008;16(7):3704-13. Epub Feb. 7, 2008.
Kwoh, D.Y. et al., Transcription-based amplification system and detection of amplified human immunodeficiency virus type 1 with a bead-based sandwich hybridization format. Proc Natl Acad Sci U S A. Feb. 1989;86(4):1173-7.
Kwissa, M. et al., Cytokine-facilitated priming of CD8+ T cell responses by DNA vaccination. J Mol Med (Berl). Feb. 2003;81(2):91-101. Epub Nov. 22, 2002.
Lacour, F. et al., Transplantable malignant tumors in mice induced by preparations containing ribonucleic acid extracted from human and mouse tumors. J. Natl Cancer Inst., 1960, 24(2):301-27.
Lai, C.J. et al., Patterning of the neural ectoderm of Xenopus laevis by the amino-terminal product of hedgehog autoproteolytic cleavage. Development. Aug. 1995;121(8):2349-60.
Lai, S.K., et al., Rapid transport of large polymeric nanoparticles in fresh undiluted human mucus. PNAS. Jan. 30, 2007; 104(5): 1482-1487.
Lai, S.K., et al., Mucus-penetrating nanoparticles for drug and gene delivery to mucosal tissues. Adv Drug Deliv Rev. Feb. 27, 2009; 61(2): 158-171.
Lange, T.S. et al., Transient nucleolar localization of U6 small nuclear RNA in Xenopus Laevis oocytes. Mol Biol Cell. Jul. 2000;11(7):2419-28.
Langford, C.J. et al., Evidence for an intron-contained sequence required for the splicing of yeast RNA polymerase II transcripts. Cell. Jun. 1983;33(2):519-27.
Larregina, A.T. et al., Changing paradigms in cutaneous immunology: adapting with dendritic cells. J Invest Dermatol. Jan. 2005;124(1):1-12.
Latarjet, R., Production of multiple cancers in mice having received nucleic acid extract from isologous & homologous leukemic tissues. C.R. Hebd Seances Acad. Sci., 1958, 246(5):853-5.
Lathe, R., Synthetic oligonucleotide probes deduced from amino acid sequence data: Theoretical and practical considerations. J Mol Biol. May 5, 1985;183(1):1-12.
Leader B., et al., Protein therapeutics: a summary and pharmacological classification. Nat Rev Drug Discov. Jan. 2008; 7(1): 21-39.
Lee, G. et al., Modeling pathogenesis and treatment of familial dysautonomia using patient-specific iPSCs. Nature. Sep. 17, 2009;461(7262):402-6. Epub Aug. 19, 2009.
Lee, J. et al., Molecular basis for the immunostimulatory activity of guanine nucleoside analogs: activation of Toll-like receptor 7. Proc Natl Acad Sci U S A. May 27, 2003;100(11):6646-51. Epub May 8, 2003.
Lee, J. T., et al., An arginine to glutamine mutation in residue 109 of human ornithine transcarbamylase completely abolishes enzymatic activity in Cos1 cells. J. Clin. Invest. Dec. 1989; 84: 1762-1766.
Lehto, T., et al., Cell-penetrating peptides for the delivery of nucleic acids. Expert Opin. Drug Deliv. Jul. 2012; (7):823-836.
Leitner, W.W. et al., DNA and RNA-based vaccines: principles, progress and prospects. Vaccine. Dec. 10, 1999;18(9-10):765-77.
Lenz, A. et al., Human and murine dermis contain dendritic cells. Isolation by means of a novel method and phenotypical and functional characterization. J Clin Invest. Dec. 1993;92(6):2587-96.
Lerner, M.R. et al., Are snRNPs involved in splicing? Nature. Jan. 10, 1980;283(5743):220-4.
Lesaffre, B. et al., Direct non-cell autonomous Pax6 activity regulates eye development in the zebrafish. Neural Dev. Jan. 17, 2007;2:2.
Lewandowski, L.J. et al., Separation of the infectious ribonucleic acid of potato spindle tuber virus from double-stranded ribonucleic acid of plant tissue extracts. J Virol. Nov. 1971;8(5):809-12.
Lewis, David, Dynamic Polyconjugates (DPC) Technology: An elegant solution to the siRNA delivery problem. Arrowhead Research Corp (NASDAQ: ARWR). Nov. 2011.
Lewis, J.D. et al., The influence of 5' and 3' end structures on pre-mRNA metabolism. J Cell Sci Suppl. 1995;19:13-9.
Lewis, J.K., et al., Matrix-assisted laser desorption/ionization mass spectrometry in peptide and protein analysis. Enc of Anal Chem. 2000; R.A. Meyers (Ed.) 5880-5894.

(56) References Cited

OTHER PUBLICATIONS

Li, L. et al., Preparation and gene delivery of alkaline amino acids-based cationic liposomes. Arch Pharm Res. Jul. 2008;31(7):924-31. Epub Aug. 14, 2008.

Li, L. et al., Overcoming obstacles to develop effective and safe siRNA therapeutics. Expert Opin Biol Ther. May 2009;9(5): 609-19.

Li, X. et al., Generation of destabilized green fluorescent protein as a transcription reporter. J Biol Chem. Dec. 25, 1998;273(52):34970-5.

Lian, T. et al., Trends and developments in liposome drug delivery systems. J Pharm Sci. Jun. 2001;90(6):667-80.

Liang, X.H. et al., The spliced leader-associated RNA is a trypanosome-specific sn(o) RNA that has the potential to guide pseudouridine formation on the SL RNA. RNA. Feb. 2002;8(2):237-46.

Licatalosi, D.D. et al., Splicing regulation in neurologic disease. Neuron. Oct. 5, 2006;52(1):93-101.

Linehan, D.C. et al., Tumor-specific and HLA-A2-restricted cytolysis by tumor-associated lymphocytes in human metastatic breast cancer. J Immunol. Nov. 1, 1995;155(9):4486-91.

Lobenberg, R. et al., Improved body distribution of 14C-labelled AZT bound to nanoparticles in rats determined by radioluminography. J Drug Target. 1998;5(3):171-9.

Loging, W.T. et al., Identifying potential tumor markers and antigens by database mining and rapid expression screening. Genome Res. Sep. 2000;10(9):1393-402.

Lopez, M.F., et al., Selected reaction monitoring-mass spectrometric immunoassay responsive to parathyroid hormone and related variants. Clinical Chem. 2010; 56(2): 281-290.

Lopez-Berestein, G. et al., Treatment of systemic fungal infections with liposomal amphotericin B. Arch Intern Med. Nov. 1989;149(11)2533-6.

Lorenzi, J.C., et al., Intranasal vaccination with messenger RNA as a new approach in gene therapy: Use against tuberculosis. BMC Biotechnol. Oct. 2010; 10(77): 1-11.

Lowe, T.M. et al., A computational screen for methylation guide snoRNAs in yeast. Science. Feb. 19, 1999;283(5405):1168-71.

Lowry, W.E., et al., Generation of human induced pluripotent stem cells from dermal fibroblasts. Proc Natl Acad Sci USA. Feb. 2008; 105(8): 2883-2888.

Lukkonen, B.G. et al., A conditional U5 snRNA mutation affecting pre-mRNA splicing and nuclear pre-mRNA retention identifies SSD1/SRK1 as a general splicing mutant suppressor. Nucleic Acids Res. Sep. 1, 1999;27(17):3455-65.

Lund, P.E., et al., Pseudovirions as vehicles for the delivery of siRNA. Pharm Res. Mar. 2010; 27(3): 400-420. Epub Dec. 9, 2009.

Luo, D. et al., Synthetic DNA delivery systems. Nat Biotechnol. Jan. 2000;18(1):33-7.

Ma, X. et al., Pseudouridylation (Psi) of U2 snRNA in S. cerevisiae is catalyzed by an RNA-independent mechanism. EMBO J. Apr. 15, 2003;22(8):1889-97.

Mackie, G.A., Vectors for the synthesis of specific RNAs in vitro. Biotechnology. 1988;10:253-67.

Maden, B.E.H. et al., Classical and novel approaches to the detection and localization of the numerous modified nucleotides in eukaryotic ribosomal RNA. Biochimie. 1995;77(1-2):22-9.

Langer, R., New methods of drug delivery. Science. Sep. 28, 1990;249(4976):1527-33.

Magee, W.E. et al., Marked stimulation of lymphocyte-mediated attack on tumor cells by target-directed liposomes containing immune RNA. Cancer Res., 1978, 38(4):1173-6.

Mannick, J.A. et al., Transformation of Nonimmune Lymph Node Cells to a State of Transplantation Immunity by RNA. A Preliminary Report, Ann. Surg., 1962, 156:356-66.

Mansour, S.L. et al., Disruption of the proto-oncogene int-2 in mouse embryo-derived stem-cells: a general strategy for targeting mutations to non-selectable genes. Nature, 1988, 336:348-52.

Mansour, et al., Functional Studies with Uterine RNA. PNAS, 1965, 53:764-70.

Marson, A., et al., Wnt signaling promotes reprogramming of somatic cells to pluripotency. Cell Stem Cell. Aug. 2008; 3(2): 132-135.

Martin, S.A. et al., Purification of mRNA guanylyltransferase and mRNA (guanine-7-) methyltransferase from vaccinia virions. J Biol Chem. Dec. 25, 1975;250(24):9322-9.

Martinon, F. et al., Induction of virus-specific cytotoxic T lymphocytes in vivo by liposome-entrapped mRNA. Eur J Immunol. Jul. 1993;23(7):1719-22.

Massenet, S. et al., Pseudouridine mapping in the *Saccharomyces cerevisiae* spliceosomal U small nuclear RNAs (snRNAs) reveals that pseudouridine synthase pus1p exhibits a dual substrate specificity for U2 snRNA and tRNA. Mol Cell Biol. Mar. 1999;19(3):2142-54.

Mathers, A.R. et al., Professional antigen-presenting cells of the skin. Immunol Res. 2006;36(1-3):127-36.

Matray, T.J. et al., Synthesis and properties of RNA analogs-oligoribonucleotide N3'→P5' phosphoramidates. Nucleic Acids Res. Oct. 15, 1999;27(20):3976-85.

Maurer, N., et al., Spontaneous entrapment of polynucleotides upon electrostatic interaction with ethanol-destabilized cationic liposomes. Biophys J. May 2001; 80(5): 2310-2326.

Mayfield, S.P. et al., Expression and assembly of a fully active antibody in algae. Proc Natl Acad Sci U S A. Jan. 21, 2003;100(2):438-42. Epub Jan. 8, 2003.

McCafferty, J. et al., Phage antibodies: filamentous phage displaying antibody variable domains. Nature. Dec. 6, 1990;348(6301):552-4.

McCormack, A.L., et al., a-Synuclein suppression by targeted small interfering RNA in the primate substantia nigra. PLoS One. Aug. 2010; 5(8): e12122.

McCormack, M., et al., Activation of the T-cell oncogene LMO2 after gene therapy for X-linked severe combined immunodeficiency. N Engl J Med. Feb. 2004; 350: 913-922.

McDonald, J.D., et al., Characterization of mutations at the mouse phenylalanine hydroxylase locus. Genomics. 1997; 39: 402-405.

McElwee, K.J. et al., Transfer of CD8(+) cells induces localized hair loss whereas CD4(+)/CD25(-) cells promote systemic alopecia areata and CD4(+)/CD25(+) cells blockade disease onset in the C3H/HeJ mouse model. J Invest Dermatol. May 2005;124(5):947-57.

McGee, M., et al., The Quantitative determination of phenylalanine hydroxylase in rat tissues. Biochem. J. 1972; 127:669-674.

McGlynn, R. et al., Differential subcellular localization of cholesterol, gangliosides, and glycosaminoglycans in murine models of mucopolysaccharide storage disorders. J Comp Neurol. Dec. 20, 2004;480(4):415-26.

McKenzie, B.S. et al., Nucleic acid vaccines: tasks and tactics. Immunol Res. 2001;24(3):225-44.

McLean, M.J., et al., Membrane differentiation of cardiac myoblasts induced in vitro by an RNA-enriched fraction from adult heart. Exp Cell Res. Nov. 1977;110(1):1-14.

MEGAscript Kit Product Manual, Ambion/Invitrogen website: http://tools.invitrogen.com/content/sfs/manuals/cms_072987.pdf, Publication Date: Oct. 27, 2009 (last accessed Mar. 17, 2013)("Ambion").

Mellits, K.H. et al., Removal of double-stranded contaminants from RNA transcripts: synthesis of adenovirus VA RNAI from a T7 vector. Nucleic Acids Res. Sep. 25, 1990;18(18):5401-6.

Meunier, L. et al, Heterogeneous populations of class II MHC+ cells in human dermal cell suspensions. Identification of a small subset responsible for potent dermal antigen-presenting cell activity with features analogous to Langerhans cells. J Immunol. Oct. 15, 1993;151(8):4067-80.

Mignone, F. et al., Untranslated regions of mRNAs. Genome Biol. 2002;3(3):REVIEWS0004. Epub Feb. 28, 2002. pp. 1-10.

Minks, M.A. et al., Structural requirements of double-stranded RNA for the activation of 2',5'-oligo(A) polymerase and protein kinase of interferon-treated HeLa cells. J Biol Chem. Oct. 25, 1979;254(20):10180-3.

Mishra, N.C. et al., Induction by RNA of inositol independence in Neurospora crassa. Proc. Natl. Acad. Sci. U.S.A., 1975, 72(2):642-5.

Mishra, R.K. et al., Improved leishmanicidal effect of phosphorotioate antisense oligonucleotides by LDL-mediated delivery. Biochim Biophys Acta. Nov. 7, 1995;1264(2):229-37.

(56) References Cited

OTHER PUBLICATIONS

Mitchell, D.A. et al., RNA transfected dendritic cells as cancer vaccines. Curr Opin Mol Ther. Apr. 2000;2(2):176-81.
Mitchell, D.A. et al., RNA-transfected dendritic cells in cancer immunotherapy. J Clin Invest. Nov. 2000;106(9):1065-9.
Mitchell, P. et al., mRNA turnover. Curr Opin Cell Biol. Jun. 2001;13(3):320-5.
Miura, K., et al., Variation in the safety of induced pluripotent stem cell lines. Nat Biotechnology. Aug. 2009; 27(8):743-745.
Morinaga, T. et al., Primary structures of human alpha-fetoprotein and its mRNA. Proc Natl Acad Sci U S A. Aug. 1983;80(15):4604-8.
Morse, M.A. et al., Generation of dendritic cells in vitro from peripheral blood mononuclear cells with granulocyte-macrophage-colony-stimulating factor, interleukin-4, and tumor necrosis factor-alpha for use in cancer immunotherapy. Ann Surg. Jul. 1997;226(1):6-16.
Mount, S.M. et al., A catalogue of splice junction sequences. Nucleic Acids Res. Jan. 22, 1982;10(2):459-72.
Muller, M.R. et al., Transfection of dendritic cells with RNA induces CD4- and CD8-mediated T cell immunity against breast carcinomas and reveals the immunodominance of presented T cell epitopes. J Immunol. Jun. 15, 2003;170(12):5892-6.
Murakawa, G.J. et al., Direct detection of HIV-1 RNA from AIDS and ARC patient samples. DNA. May 1988;7(4):287-95.
Myette, J.R. et al., Domain structure of the vaccinia virus mRNA capping enzyme. Expression in *Escherichia coli* of a subdomain possessing the RNA 5'-triphosphatase and guanylyltransferase activities and a kinetic comparison to the full-size enzyme. J Biol Chem. May 17, 1996;271(20):11936-44.
Nagata, S., et al., Molecular cloning and expression of cDNA for human granulocyte colony-stimulating factor. Nature. Jan. 30-Feb. 5, 1986; 319(6052): 415-8.
Nagata, S., et al., The chromosomal gene structure and two mRNAs for human granulocyte colony-stimulating factor. EMBO J. Mar. 1986; 5(3): 575-81.
Nagata, T. et al., Codon optimization effect on translational efficiency of DNA vaccine in mammalian cells: analysis of plasmid DNA encoding a CTL epitope derived from microorganisms. Biochem Biophys Res Commun. Aug. 2, 1999;261(2):445-51.
Nair, S. et al., Soluble proteins delivered to dendritic cells via pH-sensitive liposomes induce primary cytotoxic T lymphocyte responses in vitro. J Exp Med. Feb. 1, 1992;175(2):609-12.
Nair, S.K. et al., Antigen-presenting cells pulsed with unfractionated tumor-derived peptides are potent tumor vaccines. Eur J Immunol. Mar. 1997;27(3):589-97.
Nair, S.K. et al., Induction of cytotoxic T cell responses and tumor immunity against unrelated tumors using telomerase reverse transcriptase RNA transfected dendritic cells. Nat Med. Sep. 2000;6(9):1011-7.
Nair, S.K. et al., Induction of primary carcinoembryonic antigen (CEA)-specific cytotoxic T lymphocytes in vitro using human dendritic cells transfected with RNA. Nat Biotechnol. Apr. 1998;16(4)364-9.
Nakamura, K. et al., A model for the autosensitization autoantibody production associated with xenogeneic thymic RNA. J Immunol. Aug. 1978;121(2):702-9.
Nakamura, K. et al., Antigen restricted hybridization between antigen primed macrophage and thymic RNA. Immunol Commun. 1981;10(4-5):367-82.
Nakamura, K. et al., Conversion of immune response patterns from high to low and low to high by an RNase-sensitive thymocyte extract. Immunology. Sep. 1980;41(1):25-35.
Nakamura, K. et al., Generation of anti-NZB red blood cell antibody-forming plasma cells from bone marrow cultures of syngeneic and allogeneic mice: functional modulation of helper T-cell subsets in autosensitization. Immunology. Mar. 1983;48(3):579-86.
Nakamura, K. et al., Intranuclear incorporation of thymic low molecular weight RNA by murine bone marrow immunoblasts and inhibition of plasma cell formation by a derivative of rifampicin. Microbiol Immunol. 1982;26(1):41-57.
Nakamura, K. et al., Mechanism of anti-DNA antibody formation. The functional modulation of helper T-subset plays the key role in both murine and human B-cell autosensitization. Microbiol Immunol. 1986;30(7):703-15.
Nakamura, K. et al.,The proliferation of plasma cells from mouse bone marrow in vitro. III. Primary and secondary immune responses associated with thymic RNA. Immunol Commun. 1979;8(5-6):511-29.
Nakamura, K., The proliferation of plasma cells from mouse bone marrow in vitro. II-Stimulation of IgG-producing cells by a RNase-sensitive thymocyte homogenate. Cell Immunol. Aug. 1976;25(2):163-77.
Nallagatla, S.R. et al., A brilliant disguise for self RNA: 5'-end and internal modifications of primary transcripts suppress elements of innate immunity. RNA Biol. Jul.-Sep. 2008;5(3):140-4. Epub Jul. 20, 2008.
Narayanan, A. et al., Role of the box C/D motif in localization of small nucleolar RNAs to coiled bodies and nucleoli. Mol Biol Cell. Jul. 1999;10(7)2131-47.
Naz, R.K. et al., Novel human prostate-specific cDNA: molecular cloning, expression, and immunobiology of the recombinant protein. Biochem Biophys Res Commun. Oct. 11, 2002;297(5):1075-84.
Needleman, S.B. et al., A general method applicable to the search for similarities in the amino acid sequence of two proteins. J Mol Biol. Mar. 1970;48(3):443-53.
Nestle, F.O. et al., Vaccination of melanoma patients with peptide- or tumor lysate-pulsed dendritic cells. Nat Med. Mar. 1998;4(3):328-32.
Neumann, E. et al., Fundamentals of electroporative delivery of drugs and genes. Bioelectrochem Bioenerg. Feb. 1999;48(1):3-16.
Newby, M.I. et al., Sculpting of the spliceosomal branch site recognition motif by a conserved pseudouridine. Nat Struct Biol. Dec. 2002;9(12):958-65.
Newman, A. et al., Mutations in yeast U5 snRNA alter the specificity of 5' splice-site cleavage. Cell. Apr. 5, 1991;65(1):115-23.
Newman, A.J. et al., U5 snRNA interacts with exon sequences at 5' and 3' splice sites. Cell. Feb. 21, 1992;68(4):743-54.
Newmark, J. et al., Preparation and properties of adducts of streptokinase and streptokinase-plasmin complex with poly ethylene glycol and pluronic polyol F38. J Appl Biochem. 1982; 4:185-9.
Ni, J. et al., Small nucleolar RNAs direct site-specific synthesis of pseudouridine in ribosomal RNA. Cell. May 16, 1997;89(4):565-73.
Nicholson, A.W. et al., Accurate in vitro cleavage by RNase III of phosphorothioate-substituted RNA processing signals in bacteriophage T7 early mRNA. Nucleic Acids Res. Feb. 25, 1988;16(4):1577-91.
Nielsen, D.A. et al., Preparation of capped RNA transcripts using T7 RNA polymerase. Nucleic Acids Res. Jul. 25, 1986;14(14):5936.
Nielsen, P.E., Peptide nucleic acids as therapeutic agents. Curr Opin Struct Biol. Jun. 1999;9(3):353-7.
Nikolin, V.P. et al., Resistance of Mice Exposed to Whole-Body Irradiation to Transplanted Hemopoietic Cells Modified with RNA Preparations. Bull. Exp. Biol. Med., 2000, 129:5571-4.
Niu, M.C. et al., Genetic Manipulation in Higher Organisms; II. Detection of Soya Protein in Seeds Derived from Soya mRNA-Treated Rice. Scientia Sinica, 1980, 23:119-23.
Niu, M.C. et al., Ribonucleic acid-induced changes in mammalian cells. Proc Natl Acad Sci U S A. Oct. 15, 1961;47:1689-700.
Matsuda, A. et al., Nucleosides. 120. Synthesis of 2'-Deoxy-?-isocytidine and 2'-Deoxy-1-methyl-?-uridine from ?-Uridine1. J Org Chem. 1981; 46:3603-3609.
Matsuda, A. et al., Synthesis of 3-Methylpseudouridine and 2'-Deoxy-3-Methyl-pseudouridine. Carbohydr Res. Mar. 1, 1982; 100: 297-302.
Bhattacharya, B.K. et al., A practical synthesis of N1-Methyl-2'-deoxy-?-uridine (?-Thymidine) and its incorporation into G-rich triple helix forming oligonucleotides. Nucleosides & Nucleotides. 1995; 14(6): 1269-1287.
Desaulniers, J.P. et al., Synthesis of 15N-enriched pseudouridine derivatives. Org Lett. Oct. 30, 2003; 5(22): 4093-4096.
Jachertz, D. et al., Treatment of P815 mastocytoma in DBA/2 mice with RNA. J Immunogen. 1974; 1: 355-362.

(56) References Cited

OTHER PUBLICATIONS

McGary, E.C. et al., Post-transcriptional regulation of erythropoietin mRNA stability by erythropoietin mRNA-binding protein. J Biologic Chem. Mar. 28, 1997; 272(13): 8628-8634.
Hornung, V. et al., 5'-triphosphate RNA is the ligand for RIG-I. Science. Nov. 10, 2006; 314(5801): 994-997.
Davis, D.R. Stabilization of RNA stacking by pseudouridine. Nucleic Acids Res. 1995; 23(24): 5020-5026.
Monobe, M. et al., Beta-pseudouridine, a beer component, reduces radiation-induced chromosome aberrations in human lymphocytes. Mutat Res. Jul. 8, 2003; 538(1-2): 93-99.
Hanessian, S. et al., A highly stereocontrolled and efficient synthesis of alpha- and beta-pseudouridines. Tetrahedron Letters. 2003; 44: 8321-8323.
Shi, Y. et al., Identification and characterization of pancreatic eukaryotic initiation factor 2 alpha-subunit kinase, PEK, involved in translational control. Mol Cell Biol. Dec. 1998; 18(12): 7499-7509.
Nguyen, A. et al., Quantitative assessment of the use of modified nucleoside triphosphates in expression profiling: differential effects on signal intensities and impacts on expression ratios. BMC Biotechnol. Jul. 31, 2002; 2:14.
Carrington, J.C. et al., Cap-independent enhancement of translation by a plant potyvirus 5' nontranslated region. J Virol. Apr. 1990; 64(4): 1590-1597.
Gallie, D. R. The 5'-leader of tobacco mosaic virus promotes translation through enhanced recruitment of eIF4F. Nuc Acids Res. 2002; 30(15): 3401-3411.
Decatur, W. A. et al., RNA-guided nucleotide modification of ribosomal and other RNAs. J Biologic Chem. Jan. 10, 2003; 278(2): 695-698.
Badis, G. et al., A snoRNA that guides the two most conserved pseudouridine modifications within rRNA confers a growth advantage in yeast. RNA. Jul. 2003; 9(7): 771-779.
Nitin, N. et al., Peptide-linked molecular beacons for efficient delivery and rapid mRNA detection in living cells. Nuc Acids Res. 2004; 32(6): e58.
Cho, E.J. et al., mRNA capping enzyme is recruited to the transcription complex by phosphorylation of the RNA polymerase II carboxy-terminal domain. Genes Dev. Dec. 15, 1997; 11(24): 3319-3326.
Santi, D.V. Mechanistic studies of RNA modifying enzymes. RNA pseudouridine synthase and m5Cytosine methyl transferase. Nucleic Acids Symp Ser. 2000; 44: 147-148.
Strobel, I. et al., Human dendritic cells transfected with either RNA or DNA encoding influenza matrix protein M1 differ in their ability to stimulate cytotoxic T lymphocytes. Gene Ther. Dec. 2000; 7(23):2028-2035.
Takahashi, T.T. et al., mRNA display: ligand discovery, interaction analysis and beyond. Trends in Biochem Sci. Mar. 2003; 28(3): 159-165.
Niu, M.C. et al., The Developmental Potentiality of the Liver-RNA-Treated Posterior Primitive Streak in the Chick Embryo. Biol. Bull, 1968, 135:200-7.
Niu, M.C. et al., The Entrance of Exogenous RNA into the Mouse Ascites Cell. Proc. Soc. Exp. Biol. Med., 1968, 128(2):550-5.
Niu, M.C., RNA-Induced Biosynthesis of Specific Enzymes. PNAS, 1962, 48:1964-9.
Niu, M.C., Antagonistic Action of Exogenous Histone and RNA in Mouse Ascites Cells. Proc. Soc. Exp. Biol. Med., 1972, 140:256-62.
Niu, M.C., Causal Analysis of Embryonic Differentiation; I. Responsiveness of Presumptive Ectoderm as a Regulating Factor in RNA Function. Exp. Cell Res., 1971, 64:57-64.
Niu, M.C., Causal Analysis of Embryonic Differentiation; II. Dual Function of Exogenous RNA in differentiation of Presumptive Ectoderm. Exp. Cell Res., 1971, 64:65-76.
Niu, M.C., Current Evidence Concerning Chemical Inducers. Evolution of Nervous Control from Primitive Organisms. 1959, 7-30.
Niu, M.C., Functional Potentiality of Ribonucleic Acid. Acta. Unio. Int. Contra. Cancrum, third meeting Philadelphia, 1964, 20:995-6.
Niu, M.C., Genetic manipulation in higher organisms; I. Goldfish ova as materials of operation, mRNA mediated alteration of the liver specific isozymes. Scientia Sinica, 1977, 20(6):803-8.
Ma, B. et al., HPV pseudovirions as DNA delivery vehicles. Ther Deliv. Apr. 2011; 2(4): 427-430.
Shin, Jae Hun et al., Positive conversion of negative signaling of CTLA4 potentiates anti-tumor efficacy of adoptive T cell therapy in murine tumor models, Blood, 2012, No Vol. , pp. 1-29.
Sutherland, Claire L. et al., ULBPs, human ligands of the NKG2D receptor, stimulate tumor immunity with enhancement by IL-15, 2006, vol. 108, No #, pp. 1313-1319.
Wang, Haichao et al., HMG-1 as a Late Mediator of Endotoxin Lethality in Mice, Science, 1999, vol. 285, No. 284, pp. 248-251.
Bikard, David et al., Programmable repression and activation of bacterial gene expression using an engineered CRISPR-Cas system, Nucleic Acids Research Advance, 2013, No Vol. #, pp. 1-9.
Le Cong et al., Multiplex Genome Engineering Using CRISPR/Cas Systems, Science, 2013, vol. 339, No. 819, pp. 819-823.
Ornithine Carbamoyltransferase; ornithine carbamoyltransferase, mitochondrial precursor [*Homo sapiens*}; NCBI, 2010, No Vol., pp. 1-3.
Kiwaki et al., Correction of Ornithine Transcarbamylase Deficiency in Adult spfash Mice and in OTC-Deficient Human Hepatocytes with Recombinany Adenoviruses Bearing the CAG Promoter; Human Gene Therapy, 1996, vol. 7, No #, pp. 821-830.
Hwang, Woong Y et al., Efficient genome editing in zebrafish using a CRISPR-Cas system, Nature Biotechnology, 2013, No Vol. pp. 1-3.
International Search Report, PCT/US2013/75177, dated May 5, 2014, pp. 1-20.
Robbins, Majorie et al., 2'-O-methyl-modified RNAs Act as TLR7 Antagonists, Molecular Therapy, 2007, vol. 15, No. 9, pp. 1663-1669.
Kandimalla, Ekambar R. et al.Design, synthesis and biological evaluation of novel antagonist compounds of Toll-like receptors 7,8 and 9, Nucleic Acids Research, 2013, vol. 41, No. 6, pp. 3947-3961.
Hochreiter-Hufford, Amelia et al., And Digestion Clearing the Dead: Apoptotic Cell Sensing, Recognition, Engulfment, Cold Spring Harb Perspect Biol, 2013, No Vol #, pp. 1-20.
Kim, Sunjung et al, Transcriptional Suppression of Interleukin-12 Gene Expression following Phagocytosis of Apoptotic Cells, Immunity, 2004, vol. 21, No #, pp. 643-653.
Broz, Petr et al., Newly described pattern recognition receptors team up against intracellular pathogens, Nature Reviews, Immunology, 2013, vol. 13, No. #, pp. 551-565.
Bonham, Kevin S. et al., A Promiscuous Lipid-Binding Protein Diversifies the Subcellular Sites of Toll-like Receptor Signal Transduction, Cell, 2014, vol. 156, No #, pp. 705-716.
Ravichandran, Kodi S., Find-me and eat-me signals in apoptotic cell clearance: progress and conundrums, JEM, 2010, vol. 207, pp. 1807-1817.
Stuart, Lynda M. et al., Cell Maturation upon Endotoxin-Driven Myeloid Dendritic Inhibitory Effects of Apoptotic Cell Ingestion, The Journal of Immunology, 2002, vol. 168, No #, pp. 1627-1635.
Wallet, Mark A et al., Immunoregulation of Dendritic Cells, Clinical Medicine & Research, 2005, Vo. 3, No. 3, pp. 166-175.
Williams, Charlotte A. et al, Apoptotic cells induce dendritic cell-mediated suppression via interferon-c-induced IDO, Immunology, 2007, vol. 124, No #, pp. 89-101.
Keegan, Liam P. et al., The Many Roles of an RNA Editor, Nature Reviews, Genetics, 2001, vol. 2, No #, pp. 869-878.
Felden, Brice et al., Presence and location of modified nucleotides in *Escherichia colit* mRNA: structural mimicry with tRNA acceptor branches, The EMBO Journal, 1998, vol. 17 No. 11 pp. 3188-3196.
Doffek, Kara et al., Phosphatidyserine Inhibits NFkB and p38 MAPK Activation in Human Monocyte Derived Dendritic Cells, Molecular Immunology, 2011, vol. 48, No. #, pp. 1771-1777.
Oberg (Aquaporins, Production Optimization and Characterization; Thesis for the Degree of Doctor of Philosophy in Natural Science; University of Gothenburg, Department of Chemistry—Biochemistry; pp. 1-69, published May 27, 2011. No Vol.
By hAQP5 (*Homo sapiens* aquaporin 5 (AQP5) mRNA; NCBI, pp. 1-5, published Dec. 27, 2010, No. Vol.

(56) References Cited

OTHER PUBLICATIONS

Iduronate 2-Sulfatase: iduronate 2-sulfatase isofirm a preproprotien [*Homo sapiens*], NCBI, 2010, No Vol., pp. 1-4.
European Supplementary Search Report, EP11815407, Jun. 13, 2014, pp. 1-13.
Bermudez et al., Treatment with Recombinant Granulocyte Colony-stimulating Factor (Filgrastin) Stimulates Neutrophils and Tissue /macrophages and Induces an Effective non-specific Response Against *Mycobacterium avium* in Mice, Immunology,1998, vol. 94, No. 3, pp. 297-303.
Sheridan, W. et al., Effects of Peripheral-Blood Progenitor Cells Mobilised by Filgrastim (G-CSF) on Platelet Recovery After High-Dose Chemotherapy, The Lancet, 1992, vol. 339, pp. 640-644.
Alpha Galactosidase A; alpha-galactosidase A precursor [ *Homo sapiens*] NCBI, 2010, pp. 1-4.
Ziegler et al., AAV2 Vector Harboring a Liver-Restricted Promoter Facilates Sustained Expression of Therapeutic Levels of a-Galactosidase A and the Induction of Immune Tolerance in Fabry Mice, Molecular Therapy, 2004, vol. 9, No. 2, pp. 231-240.
International Search Report from International Application No. PCT/US2012/068714, dated Aug. 6, 2013.
Iduronate 2-Sulfatase; iduronate 2-sulfatase isofrom a preproprotein [ *Homo sapiens*]; NCBI, 2010, pp. 1-4.
Braun et al., Preclinical Studies of Lymphocyte Gene Therapy for Mild Hunter Syndrome (Mucopolysaccharidosis Type II); Human Gene Therapy, 1996, Vol. , No #, pp. 283-290.
Desmond Padhi et al., Single-Dose, Placebo-Controlled, Randomized Study of AMG 785, a Sclerostin Monoclonal Antibody, Journal of Bone and Mineral Research, vol. 26, No. 1, 2011, pp. 19-26.
Yu, Alice et al, Anti-GD2 Antibody with GM-CSF, Interleukin-2, and Isotretinoin for Neuroblastoma,The New England Journal of Medicine, 2010, vol. 363; No. 14, pp. 1324-1334.
Carboxypeptidas N, Carboxypeptidas N caralytic Chanin precursor [*Homo sapiens*] NCBI, 2010, pp. 1-4.
Ponsaerts, P. et al., Messenger RNA electroporation of human monocytes, followed by rapid in vitro differentiation, leads to highly stimulatory antigen-loaded mature dendritic cells. J Immunol. Aug. 15, 2002;169(4):1669-75.
Porgador, A. et al., Induction of antitumor immunity using bone marrow-generated dendritic cells. J Immunol. Apr. 15, 1996;156(8):2918-26.
Pradilla, G. et al., Prevention of vasospasm following subarachnoid hemorrhage in rabbits by anti-CD11/CD18 monoclonal antibody therapy. J Neurosurg. Jul. 2004;101(1):88-92.
Preisler, H.D. et al., Sensitization in vitro to murine myeloblastic leukemia cells by xenogeneic immune RNA. J Natl Cancer Inst. Jan. 1979;62(1):133-7.
Preiss, T. et al., Dual function of the messenger RNA cap structure in poly(A)-tail-promoted translation in yeast. Nature. Apr. 2, 1998;392(6675):516-20.
Probst, J., et al., Spontaneous cellular uptake of exogenous messenger RNA in vivo is nucleic acid-specific, saturable and ion dependent. Gene Therapy. 2007; 14: 1175-1180.
Puga, A. et al., Difference between functional and structural integrity of messenger RNA. Proc Natl Acad Sci U S A. Jul. 1973;70(7):2171-5.
Pulford, B., et al., Liposome-siRNA-peptide complexes cross the blood-brain barrier and significantly decrease PrPC on neuronal cells and PrPRES in infected cell cultures. PLoS One. 2010; 5(6): e11085.
Purchio, A.F. et al., [24] Methods for molecular cloning in eukaryotic cells. Methods Enzymol. 1979; 68:357-75.
Query, C.C. et al., Branch nucleophile selection in pre-mRNA splicing: evidence for the bulged duplex model. Genes Dev. Mar. 1, 1994;8(5):587-97.
Rabinovich, P.M., et al., Synthetic messenger RNA as a tool for gene therapy. Hum. Gene Ther. Oct. 2006; 17:1027-1035.
Rabinovich, P.M., et al., Chimeric receptor mRNA transfection as a tool to generate Antineoplastic Lymphocytes. Hum. Gene Ther. Jan. 2009; 20: 51-61.

Raff, M., Adult stem cell plasticity: fact or artifact? Annu Rev Cell Dev Biol. 2003;19:1-22.
Rajagopalan, L.E. et al., Turnover and translation of in vitro synthesized messenger RNAs in transfected, normal cells. J Biol Chem. Aug. 16, 1996;271(33):19871-6.
Ramazeilles, C. et al., Antisense phosphorothioate oligonucleotides: selective killing of the intracellular parasite Leishmania amazonensis. Proc Natl Acad Sci U S A. Aug. 16, 1994;91(17):7859-63.
Rammensee, H.G. et al., Peptides naturally presented by MHC class I molecules. Annu Rev Immunol. 1993;11:213-44.
Rascati, R.J. et al., Characterization of Fv-1 gene-product-mediated resistance transfer. Intervirology. 1981;15(2):87-96.
Ratajczak, J. et al., Embryonic stem cell-derived microvesicles reprogram hematopoietic progenitors: evidence for horizontal transfer of mRNA and protein delivery. Leukemia. May 2006;20(5):847-56.
Ratajczak, J. et al., Membrane-derived microvesicles: important and underappreciated mediators of cell-to-cell communication. Leukemia. Sep. 2006;20(9):1487-95. Epub Jul. 20, 2006.
Read, M.L., et al., A versatile reducible polycation-based system for efficient delivery of a broad range of nucleic acids. Nucleic Acids Res. 2005; 33(9): e86.
Reddy, A. et al., The effect of labour and placental separation on the shedding of syncytiotrophoblast microparticles, cell-free DNA and mRNA in normal pregnancy and pre-eclampsia. Placenta. Nov. 2008;29(11):942-9. Epub Oct. 1, 2008.
Reed, R. et al., Intron sequences involved in lariat formation during pre-mRNA splicing. Cell. May 1985;41(1):95-105.
Regnier, P. et al., Degradation of mRNA in bacteria: emergence of ubiquitous features. Bioessays. Mar. 2000;22(3):235-44.
Rejman, J., et al., mRNA transfection of cervical carcinoma and mesenchymal stem cells mediated by cationic carriers. J Controlled Rel. Nov. 2010; 147(3): 385-391.
Renkvist, N. et al., A listing of human tumor antigens recognized by T cells. Cancer Immunol Immunother. Mar. 2001;50(1):3-15.
Reyes-Sandoval, A. et al., DNA Vaccines. Curr Mol Med. May 2001;1(2):217-43.
Reynolds, B.A. et al., Generation of neurons and astrocytes from isolated cells of the adult mammalian central nervous system. Science. Mar. 27, 1992;255(5052):1707-10.
Ruhnke, M. et al., Long-term culture and differentiation of rat embryonic stem cell-like cells into neuronal, glial, endothelial, and hepatic lineages. Stem Cells. 2003;21(4):428-36.
Richter, J.D., Cytoplasmic polyadenylation in development and beyond. Microbiol Mol Biol Rev. Jun. 1999;63(2):446-56.
Roberts, J.N. et al., Genital transmission of HPV in a mouse model is potentiated by nonoxynol-9 and inhibited by carrageenan. Nat Med. Jul. 2007; 13(7): 857-861.
Robbins, P.F. et al., Human tumor antigens recognized by T cells. Curr Opin Immunol. Oct. 1996;8(5):628-36.
Robinson, F. et al., Expression of human nPTB is limited by extreme suboptimal codon content. PLoS One. Mar. 12, 2008;3(3):e1801.
Robinson, H.L. et al., Protection against a lethal influenza virus challenge by immunization with a haemagglutinin-expressing plasmid DNA. Vaccine. 1993;11(9):957-60.
Robles, A.I. et al., Reduced skin tumor development in cyclin D1-deficient mice highlights the oncogenic ras pathway in vivo. Genes Dev. Aug. 15, 1998;12(16):2469-74.
Rock, K.L. et al., A new foreign policy: MHC class I molecules monitor the outside world. Immunol Today. Mar. 1996;17(3):131-7.
Rodriguez, P.L. et al., Minimal "self" peptides that inhibit phagocytic clearance and enhance delivery of nanoparticles. Science. Feb. 22, 2013; 339(6122): 971-975.
Rohloff, C.M., et al., DUROS® Technology delivers peptides and proteins at consistent rate continuously for 3 to 12 months. J Diabetes Sci Technol. May 2008; 2(3): 461-467.
Romani, N. et al., Generation of mature dendritic cells from human blood. An improved method with special regard to clinical applicability. J Immunol Methods. Sep. 27, 1996;196(2):137-51.
Romani, N. et al., Presentation of exogenous protein antigens by dendritic cells to T cell clones. Intact protein is presented best by immature, epidermal Langerhans cells. J Exp Med. Mar. 1, 1989;169(3):1169-78.

(56) References Cited

OTHER PUBLICATIONS

Rosa, A., et al., Synthetic mRNAs: Powerful tools for reprogramming and differentiation of human cells. Cell Stem Cell. Nov. 2010; 7: 549-550.

Rosenberg, S.A. et al., Cancer immunotherapy: moving beyond current vaccines. Nat Med. Sep. 2004;10(9):909-15.

Ross, B.S. et al., Synthesis and incorporation of 2'-O-methyl-pseudouridine into oligonucleotides. Nucleosides and Nucleotides. 1997; 16(7/9):1547-9.

Ross, J. Control of messenger RNA stability in higher eukaryotes. Trends Genet. May 1996;12(5):171-5.

Rossi, Derrick. Open letter Entitled "Change to mRNA Reprogramming Protocol" Publication Date: Aug. 13, 2011 ("Rossi")(available at Addgene website: http://www.addgene.org/static/data/83/87/3686c0f2-c9a2-11e0-b8a9-003048dd6500.pdf, last retrieved Mar. 17, 2013).

Ryser, M., et al., S1P1 overexpression stimulates S1P-dependent chemotaxis of human CD34+ hematopoietic progenitor cells but strongly inhibits SDF-1/CXCR4-dependent migration and in vivo homing. Mol Immunology. 2008; 46: 166-171.

Saenz-Badillos, J. et al., RNA as a tumor vaccine: a review of the literature. Exp Dermatol. Jun. 2001;10(3):143-54.

Saison-Behmoaras, T. et al., Short modified antisense oligonucleotides directed against Ha-ras point mutation induce selective cleavage of the mRNA and inhibit T24 cells proliferation. EMBO J. May 1991;10(5):1111-8.

Saito, K. et al., Cell participation in immune response by immune ribonucleic acid. I. The role of T lymphocytes in immune response by immune RNA against T-dependent antigens. Immunology. Dec. 1980;41(4):937-45.

Saito, R., et al., Distribution of liposomes into brain and rat brain tumor models by convection-enhanced delivery monitored with magnetic resonance imaging. Cancer Res. Apr. 2004; 64: 2572-2579.

Sakuma, S. et al., Mucoadhesion of polystyrene nanoparticles having surface hydrophilic polymeric chains in the gastrointestinal tract. Int J Pharm. Jan. 1999 25;177(2):161-72.

Samarsky, D.A. et al., The snoRNA box C/D motif directs nucleolar targeting and also couples snoRNA synthesis and localization. EMBO J. Jul. 1, 1998;17(13):3747-57.

Santini, S.M. et al., Type I interferon as a powerful adjuvant for monocyte-derived dendritic cell development and activity in vitro and in Hu-PBL-SCID mice. J Exp Med. May 15, 2000;191(10):1777-88.

Sanyal, S. et al., Effects of RNA on the developmental potentiality of the posterior primitive streak of the chick blastoderm. Proc Natl Acad Sci U S A. Apr. 1966;55(4):743-50.

Saponara, A.G. et al., The isolation from ribonucleic acid of substituted uridines containing alpha-aminobutyrate moieties derived from methionine. Biochim Biophys Acta. Apr. 27, 1974;349(1):61-77.

Satoh, M. et al., X-linked immunodeficient mice spontaneously produce lupus-related anti-RNA helicase A autoantibodies, but are resistant to pristane-induced lupus. Int Immunol. Sep. 2003;15(9):1117-24.

Satthaporn, S. et al., Dendritic cells (II): Role and therapeutic implications in cancer. J R Coll Surg Edinb. Jun. 2001;46(3):159-67.

Satz, M.L. et al., Mechanism of immune transfer by RNA extracts. Immune RNA induces the synthesis of idiotype-bearing antigen receptors in noncommitted cells. Mol Cell Biochem. Dec. 16, 1980;33(3):105-13.

Scheel, B. et al., Immunostimulating capacities of stabilized RNA molecules. Eur J Immunol. Feb. 2004;34(2):537-47.

Schirrmacher, V. et al., Intra-pinna anti-tumor vaccination with self-replicating infectious RNA or with DNA encoding a model tumor antigen and a cytokine. Gene Ther. Jul. 2000;7(13):1137-47.

Schmidt, W.M. et al., CapSelect: a highly sensitive method for 5' CAP-dependent enrichment of full-length cDNA in PCR-mediated analysis of mRNAs. Nucleic Acids Res. Nov. 1, 1999;27(21):e31.

Schmitt, W.E. et al., In vitro induction of a bladder cancer-specific T-cell response by mRNA-transfected dendritic cells. J Cancer Res Clin Oncol. 2001;127(3):203-6.

Scholte, B.J. et al., Animal models of cystic fibrosis. J Cyst Fibros. Aug. 2004;3 Suppl 2:183-90.

Schott, J.W., et al., Viral and non-viral approaches for transient delivery of mRNA and proteins. Current Gene Ther. 2011; 11(5): 382-398.

Schuler, G. et al., Murine epidermal Langerhans cells mature into potent immunostimulatory dendritic cells in vitro. J Exp Med. Mar. 1, 1985;161(3):526-46.

Schuler-Thurner, B. et al., Mage-3 and influenza-matrix peptide-specific cytotoxic T cells are inducible in terminal stage HLA-A2.1+ melanoma patients by mature monocyte-derived dendritic cells. J Immunol. Sep. 15, 2000;165(6):3492-6.

Segura, J., et al., Monitoring gene therapy by external imaging of mRNA: Pilot study on murine erythropoietin. Ther Drug Monit. Oct. 2007; 29(5): 612-8.

Semple, S.C., et al., Efficient encapsulation of antisense oligonucleotides in lipid vesicles using ionizable aminolipids: formation of novel small multilamellar vesicle structures. Biochim Biophys Acta. Feb. 9, 2001; 1510(1-2): 152-166.

Semple, S.C., et al., Rational design of cationic lipids for siRNA delivery. Nat Biotechnol. Feb. 2010; 28(2): 172-176.

Serrate, S. et al., Transfer of cellular immunity in vivo with immune RNA in an allogeneic murine model. Clin Immunol Immunopathol. Jan. 1982;22(1):75-82.

Sharp, J.S. et al., Effect of translational signals on mRNA decay in Bacillus subtilis. J Bacteriol. Sep. 2003;185(18):5372-9.

Sharp, P.M. et al., DNA sequence evolution: the sounds of silence. Philos Trans R Soc Lond B Biol Sci. Sep. 29, 1995;349(1329):241-7.

Shea, R.G. et al., Synthesis, hybridization properties and antiviral activity of lipid-oligodeoxynucleotide conjugates. Nucleic Acids Res. Jul. 11, 1990;18(13):3777-83.

Shi, Y., et al., A combined chemical and genetic approach for the generation of induced pluripotent stem cells. Cell Stem Cell. Jun. 2008; 2: 525-528.

Shingo, T. et al., Erythropoietin regulates the in vitro and in vivo production of neuronal progenitors by mammalian forebrain neural stem cells. J Neurosci. Dec. 15, 2001;21(24):9733-43.

Shuman, S. et al., Purification and characterization of a GTP-pyrophosphate exchange activity from vaccinia virions. Association of the GTP-pyrophosphate exchange activity with vaccinia mRNA guanylyltransferase . RNA (guanine-7-) methyltransferase complex (capping enzyme). J Biol Chem. Dec. 10, 1980;255(23):11588-98.

Shuman, S., Capping enzyme in eukaryotic mRNA synthesis. Prog Nucleic Acid Res Mol Biol. 1995;50:101-29.

Shuman, S., Structure, mechanism, and evolution of the mRNA capping apparatus. Prog Nucleic Acid Res Mol Biol. 2001;66:1-40.

Siena, S. et al., Expansion of Immunostimulatory Dendritic Cells from Peripheral Blood of Patients with Cancer. Oncologist. 1997;2(1):65-69.

Simonaro, C.M. et al., Joint and bone disease in mucopolysaccharidoses VI and VII: identification of new therapeutic targets and biomarkers using animal models. Pediatr Res. May 2005;57(5 Pt 1):701-7. Epub Mar. 3, 2005.

Slapikoff, S. et al., Mechanism of ribonucleic acid polymerase action. Effect of nearest neighbors on competition between uridine triphosphate and uridine triphosphate analogs for incorporation into ribonucleic acid. Biochemistry. Dec. 1967; 6(12): 3654-3658.

Sleeman, J. et al., Dynamic interactions between splicing snRNPs, coiled bodies and nucleoli revealed using snRNP protein fusions to the green fluorescent protein. Exp Cell Res. Sep. 15, 1998;243(2):290-304.

Smith, C.M. et al., Sno storm in the nucleolus: new roles for myriad small RNPs. Cell. May 30, 1997;89(5):669-72.

Smith, J.P., et al., Drug retention and distribution after intratumoral chemotherapy with fluorouracil/epinephrine injectable gel in human pancreatic cancer xenografts. Cancer Chemother Pharmacol. 1999; 44: 267-274.

Smith, K.P. et al., Interactions of U2 gene loci and their nuclear transcripts with Cajal (coiled) bodies: evidence for PreU2 within Cajal bodies. Mol Biol Cell. Sep. 2000;11(9):2987-98.

(56) References Cited

OTHER PUBLICATIONS

Smith, W.S. et al., RNA modified uridines: VI: Conformations of 3-[3-(S)-Amino-3-Carboxypropyl]Uridine (acp3U) from tRNA and 1-Methyl-3-[3-(S)-Amino-3-Carboxypropyl]Pseudouridine (m1acp3?) from rRNA. Nucleosides and Nucleotides. 1992; 11(10):1683-94.

Smits, E., et al., RNA-based gene transfer for adult stem cells and T cells. Leukemia. 2004; 18: 1898-1902.

Smull, C.E., and Ludwig, E.H. Enhancement of the plaque-forming capacity of poliovirus ribonucleic acid with basic proteins. Journal of Bacteriology. 1962; 84(5): 1035-1040.

Sohn, R.L., et al., In-vivo particle mediated delivery of mRNA to mammalian tissues: ballistic and biological effects. Wound Rep and Regen. Jul.-Aug. 2001; 287-296.

Soll, D. Enzymatic modification of transfer RNA. Science. Jul. 23, 1971; 173(3994): 293-299.

Sontheimer, E.J. et al., The U5 and U6 small nuclear RNAs as active site components of the spliceosome. Science. Dec. 24, 1993;262(5142):1989-96.

Sousa, R. et al., T7 RNA polymerase. Prog Nucleic Acid Res Mol Biol. 2003;73:1-41.

Sousa, R., Use of T7 RNA polymerase and its mutants for incorporation of nucleoside analogs into RNA. Methods Enzymol. 2000;317:65-74.

Spooner, R.A. et al., DNA vaccination for cancer treatment. Gene Ther. May 1995;2(3):173-80.

Sproat, B.S., Chemistry and applications of oligonucleotide analogues. J Biotechnol. Jul. 31, 1995;41(2-3):221-38.

Staley, J.P. et al., Mechanical devices of the spliceosome: motors, clocks, springs, and things. Cell. Feb. 6, 1998;92(3):315-26.

Stanek, D. et al., Detection of snRNP assembly intermediates in Cajal bodies by fluorescence resonance energy transfer. J Cell Biol. Sep. 27, 2004;166(7):1015-25.

Steege, D.A., Emerging features of mRNA decay in bacteria. RNA. Aug. 2000;6(8):1079-90.

Steinman, R.M. et al., Dendritic cells: antigen presentation, accessory function and clinical relevance. Adv Exp Med Biol. 1993;329:1-9.

Steinman, R.M., The dendritic cell system and its role in immunogenicity. Annu Rev Immunol. 1991;9:271-96.

Stepinski, J. et al., Synthesis and properties of mRNAs containing the novel "anti-reverse" cap analogs 7-methyl(3'-O-methyl)GpppG and 7-methyl (3'-deoxy)GpppG. RNA. Oct. 2001;7(10):1486-95.

Sterner, D.E. et al, Acetylation of histones and transcription-related factors. Microbiol Mol Biol Rev. Jun. 2000;64(2):435-59.

Stiles, D.K., et al., Widespread suppression of huntingtin with convection-enhanced delivery of siRNA. Experimental Neurology. Jan. 2012; 233(1): 463-471.

Stinchcomb, D.T. et al., Isolation and characterisation of a yeast chromosomal replicator. Nature. Nov. 1, 1979;282(5734):39-43.

Strong, V.T. et al., Incorporation of beta-globin untranslated regions into a Sindbis virus vector for augmentation of heterologous mRNA expression. Gene Ther. Jun. 1997;4(6):624-7.

Studier, F.W. et al., Use of bacteriophage T7 RNA polymerase to direct selective high-level expression of cloned genes. J Mol Biol. May 5, 1986;189(1):113-30.

Studier, F.W. et al., [6] Use of T7 RNA polymerase to direct expression of cloned genes. Methods Enzymol. 1990;185:60-89.

Su, Z. et al., Enhanced induction of telomerase-specific CD4(+) T cells using dendritic cells transfected with RNA encoding a chimeric gene product. Cancer Res. Sep. 1, 2002;62(17):5041-8.

Su, Z. et al., Immunological and clinical responses in metastatic renal cancer patients vaccinated with tumor RNA-transfected dendritic cells. Cancer Res. May 1, 2003;63(9):2127-33.

Suda, T. et al., Hydrodynamic gene delivery: its principles and applications. Mol Ther. Dec. 2007;15(12):2063-9. Epub Oct. 2, 2007.

Sullenger, B.A. et al., Emerging clinical applications of RNA. Nature. Jul. 11, 2002;418(6894):252-8.

Svinarchuk, F.P. et al., Inhibition of HIV proliferation in MT-4 cells by antisense oligonucleotide conjugated to lipophilic groups. Biochimie. 1993;75(1-2):49-54.

Takahashi, K., et al., Induction of pluripotent stem cells from mouse embryonic and adult fibroblast cultures by defined factors. Cell. Aug. 2006; 126(4): 663-76.

Takahashi, K., et al., Induction of pluripotent stem cells from adult human fibroblasts by defined factors. Cell. Nov. 2007; 131(5): 861-72.

Tam, C., et al., Cytokeratins mediate epithelial innate defense through their antimicrobial properties. J Clin Invest. Oct. 1, 2012; 122(10): 3665-3677.

Tanaka, M. et al., Inhibition of heart transplant injury and graft coronary artery disease after prolonged organ ischemia by selective protein kinase C regulators. J Thorac Cardiovasc Surg. May 2005;129(5):1160-7.

Tang, D.C. et al., Genetic immunization is a simple method for eliciting an immune response. Nature. Mar. 12, 1992;356(6365):152-4.

Tanguay, R.L. et al., Translational efficiency is regulated by the length of the 3' untranslated region. Mol Cell Biol. Jan. 1996;16(1):146-56.

Taranger, C.K. et al., Induction of dedifferentiation, genomewide transcriptional programming, and epigenetic reprogramming by extracts of carcinoma and embryonic stem cells. Mol Biol Cell. Dec. 2005;16(12):5719-35.

Tavernier, G., et al., mRNA as gene therapeutic: How to control protein expression. J. of Controlled Release. Mar. 2011; 150(3): 238-247.

Tazi, J. et al., Alternative chromatin structure at CpG islands. Cell. Mar. 23, 1990;60(6):909-20.

Teufel, R. et al., Human peripheral blood mononuclear cells transfected with messenger RNA stimulate antigen-specific cytotoxic T-lymphocytes in vitro. Cell Mol Life Sci. Aug. 2005;62(15):1755-62.

Thompson, M. et al., Nucleolar clustering of dispersed tRNA genes. Science. Nov. 21, 2003;302(5649):1399-401.

Thurner, B. et al., Vaccination with mage-3A1 peptide-pulsed mature, monocyte-derived dendritic cells expands specific cytotoxic T cells and induces regression of some metastases in advanced stage IV melanoma. J Exp Med. Dec. 6, 1999;190(11):1669-78.

Tourriere, H. et al., mRNA degradation machines in eukaryotic cells. Biochimie. Aug. 2002;84(8):821-37.

Towle, H.C. et al., Purification and characterization of bacteriophage gh-1-induced deoxyribonucleic acid-dependent ribonucleic acid polymerase from Pseudomonas putida. J Biol Chem. Mar. 10, 1975;250(5):1723-33.

Treat, J. et al., In Liposomes in the Therapy of Infectious Disease and Cancer, Lopez-Berestein and Fidler (eds.), Liss, New York, 1989. 353-65.

Trinchieri, G. et al., Cooperation of Toll-like receptor signals in innate immune defence. Nat Rev Immunol. Mar. 2007;7(3):179-90.

Trojan, A. et al., Immune reactivity against a novel HLA-A3-restricted influenza virus peptide identified by predictive algorithms and interferon-gamma quantitative PCR. J Immunother. Jan.-Feb. 2003;26(1):41-6.

Tsuchiya, M, et al., Isolation and characterization of the cDNA for murine granulocyte colony-stimulating factor. Proc Natl Acad Sci USA. Oct. 1986; 83(20): 7633-7637.

Tung, T.C. et al., Organ formation caused by nucleic acid from different class.—Urodele DNA mediated balancer formation in goldfish. Sci Sin. Jan.-Feb. 1977;20(1):56-8.

Tung, T.C. et al., The effect of carp EGG-mRNA on the transformation of goldfish tail. Sci Sin. Jan.-Feb. 1977;20(1):59-63.

Tung, T.C. et al., Transmission of the nucleic acid-induced character, caudal fin, to the offspring in goldfish. Sci Sin. Mar.-Apr. 1975;18(2):223-31.

Tuting, T. et al., Gene-based strategies for the immunotherapy of cancer. J Mol Med (Berl). Jul. 1997;75(7):478-91.

Tycowski, K.T. et al., A small nucleolar RNA requirement for site-specific ribose methylation of rRNA in Xenopus. Proc Natl Acad Sci U S A. Dec. 10, 1996;93(25):14480-5.

(56) References Cited

OTHER PUBLICATIONS

Udenfriend, S., et al., The enzymatic conversion of phenylalanine to tyrosine. J. Biol. Chem. 1952; 194: 503-511.
Ueda, T. et al., Phosphorothioate-containing RNAs show mRNA activity in the prokaryotic translation systems in vitro. Nucleic Acids Res. Feb. 11, 1991;19(3):547-52.
Ulmer, J.B. et al., Heterologous protection against influenza by injection of DNA encoding a viral protein. Science. Mar. 19, 1993;259(5102):1745-9.
Ulmer, J.B., An update on the state of the art of DNA vaccines. Curr Opin Drug Discov Devel. Mar. 2001;4(2):192-7.
Utikal, J., et al., Immortalization eliminates a roadblock during cellular reprogramming into iPS cells. Nature. Aug. 2009; 460: 1145-1148.
Uzgun, S., et al., PEGylation improves nanoparticle formation and transfection efficiency of messenger RNA. Pharm Res. Sep. 2011; 28(9); 2223-2232.
Uzri, D., et al., Nucleotide sequences and modifications that determine RIG-I/RNA binding and signaling activities. J. Virol. May 2009; 83 (9): 4174-4184.
Vaheri, A. and Pagano, J.S. Infectious poliovirus RNA: a sensitive method of assay. Virology. Nov. 1965; 27(3): 434-436.
Valcarcel, J. et al., The protein Sex-lethal antagonizes the splicing factor U2AF to regulate alternative splicing of transformer pre-mRNA. Nature. Mar. 11, 1993;362(6416):171-5.
Van Den Bosch, G.A., et al., Simultaneous activation of Viral Antigen-specific Memory CD4+ and CD8+ T-cells using mRNA-electroporated CD40-activated autologous B-cells. J Immunother. Sep./Oct. 2006; 29, 512-23.
Van Gelder, R.N. et al., Amplified RNA synthesized from limited quantities of heterogeneous cDNA. Proc Natl Acad Sci U S A. Mar. 1990;87(5):1663-7.
Van Tendeloo, V.F. et al., Highly efficient gene delivery by mRNA electroporation in human hematopoietic cells: superiority to lipofection and passive pulsing of mRNA and to electroporation of plasmid cDNA for tumor antigen loading of dendritic cells. Blood. Jul. 1, 2001;98(1):49-56.
Van Tendeloo, V.F., et al., mRNA-based gene transfer as a tool for gene and cell therapy. Curr Opin Mol Therapeutics. 2007; 9(5): 423-431.
Vaquero, C. et al., Transient expression of a tumor-specific single-chain fragment and a chimeric antibody in tobacco leaves. Proc Natl Acad Sci U S A. Sep. 28, 1999;96(20):11128-33.
Varambally, S. et al., Genomic loss of microRNA-101 leads to overexpression of histone methyltransferase EZH2 in cancer. Science. Dec. 12, 2008;322(5908):1695-9. Epub Nov. 13, 2008.
Vassilev, V.B. et al., Microparticle-mediated RNA immunization against bovine viral diarrhea virus. Vaccine. Feb. 28, 2001;19(15-16):2012-9.
Sallusto, F. et al., Dendritic cells use macropinocytosis and the mannose receptor to concentrate macromolecules in the major histocompatibility complex class II compartment: downregulation by cytokines and bacterial products. J Exp Med. Aug. 1, 1995;182(2):389-400.
Sallusto, F. et al., Efficient presentation of soluble antigen by cultured human dendritic cells is maintained by granulocyte/macrophage colony-stimulating factor plus interleukin 4 and downregulated by tumor necrosis factor alpha. J Exp Med. Apr. 1, 1994;179(4):1109-18.
Veres, G., et al., The molecular basis of the sparse fur mouse mutation. Science. Jul. 1987; 237(4813):415-7.
Verheggen, C. et al., Box C/D small nucleolar RNA trafficking involves small nucleolar RNP proteins, nucleolar factors and a novel nuclear domain. EMBO J. Oct. 1, 2001;20(19):5480-90.
Verheggen, C. et al., Mammalian and yeast U3 snoRNPs are matured in specific and related nuclear compartments. EMBO J. Jun. 3, 2002;21(11):2736-45.
Verma, I.M. et al., Gene therapy: promises, problems and prospects. Nature. Sep. 18, 1997;389(6648):239-42.

Verma, I.M. et al., Gene therapy: twenty-first century medicine. Annu Rev Biochem. 2005;74:711-38.
Verma, S. et al., Modified oligonucleotides: synthesis and strategy for users. Annu Rev Biochem. 1998;67:99-134.
Vilee, D.B., Ribonucleic acid: control of steroid synthesis in endocrine tissue. Science. Nov. 3, 1967;158(3801):652-3.
Villaret, D.B. et al., Identification of genes overexpressed in head and neck squamous cell carcinoma using a combination of complementary DNA subtraction and microarray analysis. Laryngoscope. Mar. 2000;110(3 Pt 1):374-81.
Virovic, L. et al., Novel delivery methods for treatment of viral hepatitis: an update. Expert Opin Drug Deilv. Jul. 2005;2(4):707-17.
Viza, D. et al., Human lymphoblastoid cells in culture replicate immune information carried by xenogeneic RNA. Differentiation. 1978;11(3):181-4.
Wagner, E. Polymers for siRNA delivery: Inspired by viruses to be targeted, dynamic, and precise. Acc Chem Res. 2012; 45(7): 1005-1013.
Wahle, E. Poly(A) tail length control is caused by termination of processive synthesis. J Biol Chem. Feb. 10, 1995; 270(6): 2800-2808.
Wang, B. et al., Gene inoculation generates immune responses against human immunodeficiency virus type 1. Proc Natl Acad Sci U S A. May 1, 1993;90(9):4156-60.
Wang, B. et al., Immunization by direct DNA inoculation induces rejection of tumor cell challenge. Hum Gene Ther. Apr. 1995;6(4):407-18.
Wang, B.S. et al., Fractionation of immune RNA capable of transferring tumor-specific cellular cytotoxicity. Cell Immunol. May 1978;37(2):358-68.
Wang, S.P. et al., Phylogeny of mRNA capping enzymes. Proc Natl Acad Sci U S A. Sep. 2, 1997;94(18):9573-8.
Wang, Y., et al., Systemic delivery of modified mRNA encoding herpes simplex virus 1 thymidine kinase for targeted cancer gene therapy. Mol Therapy. 2012; 11:1-10.
Warren, T.L. et al., Uses of granulocyte-macrophage colony-stimulating factor in vaccine development. Curr Opin Hematol. May 2000;7(3):168-73.
Weaver, J.C., Electroporation theory. Concepts and mechanisms. Methods Mol Biol. 1995;55:3-28.
Watanabe, T. et al., Induction of wild-type p53 activity in human cancer cells by ribozymes that repair mutant p53 transcripts. Proc Natl Acad Sci U S A. Jul. 18, 2000;97(15):8490-4.
Weber, J. et al., Granulocyte-macrophage-colony-stimulating factor added to a multipeptide vaccine for resected Stage II melanoma. Cancer Jan. 1, 2003;97(1):186-200.
Weide, B. et al., Results of the first phase I/II clinical vaccination trial with direct injection of mRNA. J Immunother. Feb.-Mar. 2008;31(2):180-8.
Weide, B., et al., Direct injection of protamine-protected mRNA: Results of a phase 1/2 vaccination trial in metastatic melanoma patients. J. of Immunotherapy. Jun. 2009; 32(5): 498-507.
Nakamura, O. et al., Abstract: The Role of Immune RNA in the Immunotherapy of Malignant Brain Tumor. 1982, 34(2):333-9.
Weisberger, A.S., Induction of altered globin synthesis in human immature erythrocytes incubated with ribonucleoprotein. Proc Natl Acad Sci USA. Jan. 1962; 48(1): 68-80.
Weiss, S.B. et al., Pseudouridine Formation: Evidence for RNA as an Intermediate. Science. Jul. 23, 1965; 149(3682): 429-431.
Weissman, D. et al., Dendritic cells express and use multiple HIV coreceptors. Adv Exp Med Biol. 1997;417:401-6.
Weissman, D. et al., HIV GAG mRNA transfection of dendritic cells (DC) delivers encoded antigen to MHC class I and II molecules, causes DC maturation, and induces a potent human in vitro primary immune response. J Immunol. Oct. 15, 2000;165(8):4710-7.
Wels, W., et al., Construction, bacterial expression and characterization of a bifunctional single-chain antibody-phosphatase fusion protein targeted to the human erbb-2 receptor. Biotechnology (NY). Oct. 1992; 10(10): 1128-1132.
Wickens, M. et al., A PUF family portrait: 3'UTR regulation as a way of life. Trends Genet. Mar. 2002;18(3):150-7.
Wiehe, J.M. et al., mRNA-mediated gene delivery into human progenitor cells promotes highly efficient protein expression. J Cell Mol Med. May-Jun. 2007;11(3):521-30.

(56) References Cited

OTHER PUBLICATIONS

Wilkie, G.S. et al., Regulation of mRNA translation by 5'- and 3'-UTR-binding factors. Trends Biochem Sci. Apr. 2003;28(4):182-8.
Wilusz, C.J. et al., Bringing the role of mRNA decay in the control of gene expression into focus. Trends Genet. Oct. 2004;20(10):491-7.
Wilusz, J. et al., A 64 kd nuclear protein binds to RNA segments that include the AAUAAA polyadenylation motif. Cell. Jan. 29, 1988;52(2):221-8.
Winnicka, B, et al., CD13 is dispensable for normal hematopoiesis and myeloid cell functions in the mouse. J Leukoc Biol. Aug. 2010; 88(2): 347-359. Epub Apr. 29, 2010.
Wolff, J.A. et al., Direct gene transfer into mouse muscle in vivo. Science. Mar. 23, 1990;247(4949 Pt 1):1465-8.
Woltjen, K. et al., PiggyBac transposition reprograms fibroblasts to induced pluripotent stem cells. Nature. Apr. 2009 (458): 10.1038-07863.
Woodberry, T. et al., Immunogenicity of a human immunodeficiency virus (HIV) polytope vaccine containing multiple HLA A2 HIV CD8(+) cytotoxic T-cell epitopes. J Virol. Jul. 1999;73(7):5320-5.
Wu, J. et al., Mammalian pre-mRNA branch site selection by U2 snRNP involves base pairing. Genes Dev. Oct. 1989;3(10):1553-61.
Wu, L. et al., Fusion protein vectors to increase protein production and evaluate the immunogenicity of genetic vaccines. Mol Ther. Sep. 2000;2(3):288-97.
Wu, X.C. et al., Engineering a Bacillus subtilis expression-secretion system with a strain deficient in six extracellular proteases. J Bacteriol. Aug. 1991;173(16):4952-8.
Wurm, F. et al., Suppression of melanoma development and regression of melanoma in xiphophorine fish after treatment with immune RNA. Cancer Res. Sep. 1981;41(9 Pt 1):3377-83.
Wyatt, J.R. et al., Site-specific cross-linking of mammalian U5 snRNP to the 5' splice site before the first step of pre-mRNA splicing. Genes Dev. Dec. 1992;6(12B):2542-53.
Xu, C. et al., Feeder-free growth of undifferentiated human embryonic stem cells. Nat Biotechnol. Oct. 2001;19(10):971-4.
Xu, J. et al., Identification of differentially expressed genes in human prostate cancer using subtraction and microarray. Cancer Res. Mar. 15, 2000;60(6):1677-82.
Yamamoto, A., et al., Current prospects for mRNA gene delivery. Eur J Pharm Biopharm. Mar. 2009; 71(3):484-489.
Yamashita, A. et al., Concerted action of poly(A) nucleases and decapping enzyme in mammalian mRNA turnover. Nat Struct Mol Biol. Dec. 2005;12(12):1054-63. Epub Nov. 13, 2005.
Yang, S.F. et al., Albumin synthesis in mouse uterus in response to liver mRNA. Proc Natl Acad Sci U S A. May 1977;74(5):1894-8.
Szabo, E. et al., Direct conversion of human fibroblasts to multilineage blood progenitors. Nature. Nov. 25, 2010; 468(7323): 521-526.
Gonzalez, F. et al., Generation of mouse-induced pluripotent stem cells by transient expression of a single nonviral polycistronic vector. Proc Natl Acad Sci USA. Jun. 2, 2009; 106(22): 8918-8922.
Aasen, T. et al., Efficient and rapid generation of induced pluripotent stem cells from human keratinocytes. Nat Biotechnol. Nov. 2008; 26(11): 1276-1284.
Ebert, A.D. et al., Induced pluripotent stem cells from a spinal muscular atrophy patient. Nature. Jan. 15, 2009; 457(7227): 277-280.o.
Vierbuchen, T. et al., Direct conversion of fibroblasts to functional neurons by defined factors. Nature. Feb. 25, 2010; 463(7284): 1035-1041.
Racila, D. et al., Transient expression of OCT4 is sufficient to allow human keratinocytes to change their differentiation pathway. Gene Ther. Mar. 2011; 18(3): 294-303.
Nakagawa, M. et al., Generation of induced pluripotent stem cells without Myc from mouse and human fibroblasts. Nat Biotechnol. Jan. 2008; 26(1): 101-106. Epub Nov. 30, 2007.
Haft, D.H. et al., A guild of 45 CRISPR-associated (CAS) protein families and multiple CRISPR/CAS subtypes exist in prokaryotic genomes. PLoS Comput Biol. Nov. 2005; 1(6): e60. Epub Nov. 11, 2005.

Brown, C.E., et al., Poly(A) Tail Lengeth Control in *Saccharomyces cerevisiae* Occurs by Message-Specific Deadenylation. Molecular and Cellular Biology, Nov. 1998 p. 6548-6559.
Gao, G., et al., Erythropoietin gene therapy leads to autoimmune anemia in macaques. 2004 103: 3300-3302.
Liu, C., et al., Peptidoglycan Recognition Proteins. A Novel Family of Four Human Innate Immunity Pattern Recognition Molecules. The Journal of Biological Chemistry. vol. 276, No. 37, Issue of Sep. 14, pp. 686-34694, 2001.
Lu, X., Peptidoglycan Recognition Proteins Are a New Class of Human Bactericidal Proteins. The Journal of Biological Chemistry, Mar. 3, 2006, vol. 281, No. 9, pp. 5895-5907.
Ngai, P.H.K., et al. Agrocybin, an antifungal peptide from the edible mushroom. Department of Biochemistry, The Chinese University of Hong Kong. Peptides 26 (2005) 191-196.
Endo, F., et al. A Nonsense Mutation in the 4-Hydroxyphenylpyruvic Acid Dioxygenase Gene (Hpd) Causes Skipping of the Constitutive Exon and Hypertyrosinemia in Mouse Strain III. Genomics 25, 164-169 (1995).
Neve, S., et al. Tissue distribution, intracellular localization and proteolytic processing of rat 4-hydorxyphenylpyruvate dioxygenase. Cell Biology International 27 (2003) pp. 611-624.
Ren, W., et al. Molecular clong and characterization of 4-hydroxyphenylpyruvate dioxygenase gene from Lactuca sativa. Journal of Patent Physiology 168 (2011 pp. 1076-1083).
Ruetschi, U., et al. Human 4-Hydroxyphenylpyruvate Dioxygenase Gene (HPD). Genomics 44, pp. 292-299 (1997).
Seabury, C.M., et al. Analysis of sequence variability and protein domain architectures for bovine peptidoglycan recognition protein 1 and Toll-like receptors 2 and 6. Genomics 92 (2008) pp. 235-245.
Sumathipala, N. et al., Involvement of Manduca sexta peptidoglycan recognition protein-1 in the recognition of bacteria and activation of prophenoloxidase system. Insect Biochemistry and Molecular Biology 40 (2010) 487-495.
Wei, X. et al., Molecular cloning and MRNA expression of two peptidoglycan recognition protein (PGRP genes from mollusk Solen grandis. Fish & Shellfish Immunology 32 (2012) 178-185.
Anonymous: "Messenger RNA", Internet: Wikipedia. Jun. 19, 2013, XP002699196, Retrieved from the Internet: URL: http://en.wikipedia.org/wiki/Messenger RNA.
Grosjean, H., DNA and RNA Modification Enzymes Structure, Mechanisms, Functions and Evolution. Molecular Biology Intelligence Unit. Estimated Publication Date: May 2009. pp. 1-2.
Grosjean, H., Nucleic Acids Are Not Boring Long Polymers of Only Four Types of Nucleotides: A Guided Tour. Chapter 1. Landes Bioscience. 2009. pp. 1-18.
Grosjean, H., et al. How Nucleic Acids Cope with High Temperature. Physiology and Biochemistry of Extremophiles. 2007. Chapter 4, pp. 39-58.
Hunt, D.M., et al., The L Protein of Vesicular Stomatitis Cirus Modulates the Response of the Polyadenylic Acid Polymerase to S-Adenosylhomocysteine. J. gen. Virol. (1988), 69, 2555-2561.
Grosjean, H., et al. Fine-Tuning of Rna Functions by Modification and Editing. Topics in Current Genetics, vol. 12, 2005, XXiV, p. 442.
Bouloy, M., et al., Both the 7-methyl and the 2'-O-methyl groups in the cap of mRNA strongly influence its ability to act as primer for influenza virus RNA transcription. Proc. Natl. Acad. Sci. USA, vol. 77, No. 7, pp. 3952-3956, Jul. 1980.
Fernandez, I., et al. Unusual base pairing during the decoding of a stop codon by the ribosome. vol. 000, 2013. pp. 1-5.
Edelheit, S. et al., Transcriptome-Wide Mapping of 5-methylcytidine RNA Modifications in Bacteria, Archaea, and Yeast Revelas m5C within Archaeal mRNAs. PLOS Genetics, Jun. 2013, vol. 9, Issue 6, pp. 1-14.
Cun, Dongmei, et al., Preparation and characterization of poly(DL-lactide-co-glycolide) nanoparticles for siRNA delivery. International Journal of Pharmaceutics 390 (2010) 70-75.
Oster, C.G., et al. Comparative study of DNA encapsulation into PLGA microparticles using modified double emulsion methods and spray drying techniques. Journal of Microencapsulation, May 2005; 22(3): 235-244.
Thomson A. James., et al. Isolation of a primate embryonic stem cell line. vol. 92, pp. 7844-7848, Aug. 1995. Proc. Natl. Acad. Sci. USA.

(56) References Cited

OTHER PUBLICATIONS

Tahiliani., et al.Conversion of 5-Methylcytosine to 5-Hydroxymethylcytosine in Mammalian DNA by MLL Partner TET1 Science 324, 930 (2009);www.sciencemag.org.
The Human Embryonic Stem Cell and the Human Embryonic Germ Cell. NIH Stem Cells: Scientific Progress and Future Research Directions, Department of Health and Human Services, Chapter 3, Jun. 2001.
The Stem Cell. NIH Stem Cells: Scientific Progress and Future Research Directions, Department of Health and Human Services, Chapter 1, Jun. 2001.
Morgan D. Hugh, et. al. Molecular Basis of Cell and Developmental Biology:Activation-induced Cytidine Dreaminase Deaminates 5-Methylcytosine in DNA and Is Expressed in Pluripotent Tissues: Implications for Epigenetic Reprogramming. J. Biol. Chem. 2004, 279:52353-52360. published online Sep. 24, 2004.
Moore, J.E., et. al. The Corneal Epithelial Stem Cell. vol. 21, Nos. 5/6, 2002. Mary Ann Liebert, Inc. pp. 443-451.
Koh, Peng Kian, et.al. Tet1 and Tet2 Regulate 5-Hydroxymethylcytosine Production and Cell Lineage Specification in Mouse Embryonic Stem Cells. 200-213, Feb. 4, 2011 ªª2011 Elsevier Inc.
Kariko, Katalin, et.al. Naturally occurring nucleoside modifications suppress the immunostimulatory activity of RNA: Implication for therapeutic RNA development. Current Opinion in Drug Discovery & Development 2007 10(5) 523-532 The Thomson Corporation ISSN 1367-6733.
Ito, Shinsuke, et.al. Role of Tet proteins in 5mC to 5hmC conversion, ES-cell self-renewal and inner cell mass specification. vol. 466|Aug. 26 2010| Macmillan Publishers Limited. pp. 1129-1133.
Freudenberg, M. Johannes, et.al. Acute depletion of Tet1-dependent 5-hydroxymethylcytosine levels impairs LIF/Stat3 signaling and results in loss of embryonic stem cell identity. Published online Dec. 30, 2011. 3364-3377 Nucleic Acids Research, 2012, vol. 40, No. 8.Published by Oxford University Press 2011.
Ficz, Gabriella, et.al. Dynamic regulation of 5-hydroxymethylcytosine in mouse ES cells and during differentiation. Nature | vol. 473 | May 19, 2011. pp. 398-401. Macmillian Publishers.
Blelloch, Robert, et.al. Generation of Induced Pluripotent Stem Cells in the Absence of Drug Selection. Sep. 13, 2007. pp. 245-247.
Verma, Sandeep, et.al. Modified Oligonucleotides: Synthesis and Strategy for Users. Biochem. 1998. 67:99-134. 1998 by Annual Reviews.
Leung W. David. The Structure and Functions of Human Lysophosphatidic Acid Acyltransferases. Frontiers in Bioscience 6. pp. 944-953, Aug. 1, 2001.
Lu, Biao, et.al. Cloning and characterization of murine 1-acyl-sn-glycerol 3-phosphate acyltransferases and their regulation by PPAR in murine heart. Biochem J. (2005) 385, 469-477 (printed in Great Britain).
West, James, et.al. Cloning and Expression of Two Human Lysophosphatidic Acid Acyltransferase cDNAs That Enhance Cytokine-Induced Signlaing Responses in Cells. DNA and Cell Biology vol. 16, Nov. 6, 1997. Mary Ann Liebert, Inc. pp. 691-791.
Bionaz, Massimo, et.al. ACSL1, AGPAT6, FABP3, LPIN1, and SLC27A6 Are the Most Abundant Isoforms in Bovine Mammary Tissue and Their Expression Is Affected by Stage of Lactation. The Journal of Nutrition, 2008. pp. 1019-2024.
Ye, X., et al., Prolonged metabolic correction in adult ornithine transcarbamylase-deficient mice with adenoviral vectors. Biological Chem. Feb. 1996; 271(7): 3639-3646.
Yi, Y., et al., Current advances in retroviral gene therapy. Current Gene Ther. 2011; 11: 218-228.
Ying, H. et al., Cancer therapy using a self-replicating RNA vaccine. Nat Med. Jul. 1999;5(7):823-7.
Yisraeli, J.K. et al., [4] Synthesis of long, capped transcripts in vitro by SP6 and T7 RNA Polymerases. Methods in Enzymology, vol. 180. 1989; 180, 42-50.
Yokoe, H. et al., Spatial dynamics of GFP-tagged proteins investigated by local fluorescence enhancement. Nat Biotechnol. Oct. 1996;14(10):1252-6.
Yoshida, Y. et al., Hypoxia enhances the generation of induced pluripotent stem cells. Cell Stem Cells 5. Sep. 2009; 5: 237-241.
You, Z. et al., A retrogen strategy for presentation of an intracellular tumor antigen as an exogenous antigen by dendritic cells induces potent antitumor T helper and CTL responses. Cancer Res. Jan. 1, 2001;61(1):197-205.
Yu, J. et al., Structural and functional analysis of an mRNP complex that mediates the high stability of human beta-globin mRNA. Mol Cell Biol. Sep. 2001;21(17):5879-88.
Yu, J. et al., Induced pluripotent stem cell lines derived from human somatic cells. Science. Dec. 21, 2007; 318(5858): 1917-1920.
Yu, J. et al., Human induced pluripotent stem cells free of vector and transgene sequences. Science. May 8, 2009; 324(5928): 797-801.
Yu, P.W. et al., Sustained correction of B-cell development and function in a murine model of X-linked agammaglobulinemia (XLA) using retroviral-mediated gene transfer. Blood. Sep. 1, 2004;104(5):1281-90. Epub May 13, 2004.
Yu, Y.T. et al., Internal modification of U2 small nuclear (sn)RNA occurs in nucleoli of Xenopus oocytes. J Cell Biol. Mar. 19, 2001;152(6):1279-88.
Yu, Y.T. et al., Modifications of U2 snRNA are required for snRNP assembly and pre-mRNA splicing. EMBO J. Oct. 1, 1998;17(19):5783-95.
Zebarjadian, Y. et al., Point mutations in yeast CBF5 can abolish in vivo pseudouridylation of rRNA. Mol Cell Biol. Nov. 1999;19(11):7461-72.
Zeitlin, S. et al., In vivo splicing products of the rabbit beta-globin pre-mRNA. Cell. Dec. 1984;39(3 Pt 2):589-602.
Zelcer, A. et al., the detection and characterization of viral-related double-stranded RNAs in tobacco mosaic virus-infected infected plants. Virology. Sep. 1981;113(2):417-27.
Zeytin, H.E. et al., Construction and characterization of DNA vaccines encoding the single-chain variable fragment of the anti-idiotype antibody 1A7 mimicking the tumor-associated antigen disialoganglioside GD2. Cancer Gene Ther. Nov. 2000;7(11):1426-36.
Zhang, X. et al., Advances in dendritic cell-based vaccine of cancer. Cancer Biother Radiopharm. Dec. 2002;17(6):601-19.
Zhang, Y., et al., In vivo gene delivery by nonviral vectors: overcoming hurdles? Mol. Therapy. Jul. 2012; 20(7):1298-1304.
Zhao, X. et al., Pseudouridines in and near the branch site recognition region of U2 snRNA are required for snRNP biogenesis and pre-mRNA splicing in Xenopus oocytes. RNA. Apr. 2004;10(4):681-90.
Zhigaltsev, I.V., et al., Bottom-Up designand synthesis of limit size lipid nanoparticle systems with aqueous and triglyceride cores using millisecond microfluidic mixing. Langmuir. Feb. 21, 2012;28(7): 2633-3640.
Zhou, W.Z. et al., RNA melanoma vaccine: induction of antitumor immunity by human glycoprotein 100 mRNA immunization. Hum Gene Ther. Nov. 1, 1999;10(16):2719-24.
Zhou, H., et al., Generation of induced pluripotent stem cells using recombinant proteins. Cell Stem Cell. May 4, 2009(5)381-4.
Zhou, J., et al., Short Communication Bilirubin Glucuronidation Revisited: Proper assay conditions to estimate enzyme kinetics with recombinant UGT1A1. Drug metabolism and Disp. 2010; 38(11): 1907-1911.
Zhuang, Y. et al., A compensatory base change in human U2 snRNA can suppress a branch site mutation. Genes Dev. Oct. 1989;3(10):1545-52.
Zimmermann, E. et al., Electrolyte- and pH-stabilities of aqueous solid lipid nanoparticle (SLN™) dispersions in artificial gastrointestinal media. Eur J Pharm Biopharm. Sep. 2001;52(2):203-10.
Zitvogel, L. et al., Therapy of murine tumors with tumor peptide-pulsed dendritic cells: dependence on T cells, B7 costimulation, and T helper cell 1-associated cytokines. J Exp Med. Jan. 1, 1996;183(1):87-97.
Zohra, F.T., et al., Drastic effect of nanoapatite particles on liposome-mediated mRNA delivery to mammalian cells. Analytical Biochem. Oct. 2005; 345(1): 164-166.

(56) References Cited

OTHER PUBLICATIONS

Zohra, F.T., et al., Effective delivery with enhanced translational activity synergistically accelerates mRNA-based transfection. Biochem Biophys Res Comm. Jun. 2007; 358(1): 373-378.

Zonta, S. et al., Uretero-neocystostomy in a swine model of kidney transplantation: a new technique. J Surg Res. Apr. 2005;124(2):250-5.

Zorio, D.A. et al., Both subunits of U2AF recognize the 3' splice site in Caenorhabditis elegans. Nature. Dec. 16, 1999;402(6763):835-8.

Chang, N. et al., Genome editing with RNA-guided Cas9 nuclease in Zebrafish embryos. Cell Res. Apr. 2013; 23(4):465-472.

Cong, L. et al., Multiplex genome engineering using CRISPR/Cas systems. Science. Feb. 15, 2013; 339(6121):819-823.

Jinek, M. et al., A programmable dual-RNA-guided DNA endonuclease in adaptive bacterial immunity. Science. Aug. 17, 2012; 337(6096): 816-821.

Jinek, M. et al., RNA-programmed genome editing in human cells. Elife. 2013;2:e00471.

Maehr, R. et al., Generation of pluripotent stem cells from patients with type 1 diabetes. Proc Natl Acad Sci USA. Sep. 15, 2009; 106(37): 15768-15773.

Mali, P. et al., RNA-guided human genome engineering via Cas9. Science. Feb. 15, 2013; 339(6121): 823-826.

Qi, L.S. et al., Repurposing CRISPR as an RNA-guided platform for sequence-specific control of gene expression. Cell. Feb. 28, 2013; 152(5): 1173-1183.

Shen, B. et al., Generation of gene-modified mice via Cas9/RNA-mediated gene targeting. Cell Res. Apr. 2, 2013; 1-4.

International Search Report from International Application No. PCT/US10/059317 dated Aug. 22, 2011.

International Search Report from International Application No. PCT/US10/059305 dated Aug. 23, 2011.

Yi, P. et al., Betatrophin: A hormone that controls pancreatic beta cell proliferation. Cell. May 9, 2013; 153: 1-12.

Graf, T and Enver T. Forcing cells to change lineages. Nature. Dec. 3, 2009; 462(7273): 587-594.

Ieda, M. et al., Direct reprogramming of fibroblasts into functional cardiomyocytes by defined factors. Cell. Aug. 6, 2010; 142(3): 375-386.

Huangfu, D. et al., Induction of pluripotent stem cells from primary human fibroblasts with only Oct4 and Sox2. Nat Biotechnol. Nov. 2008; 26(11): 1269-1275.

Dong, X.Y. et al., Identification of genes differentially expressed in human hepatocellular carcinoma by a modified suppression subtractive hybridization method. Int J Cancer. Nov. 1, 2004; 112(2): 239-248.

Okita, K. et al., Generation of mouse induced pluripotent stem cells without viral vectors. Science. 2008; 322: 949-953.

Stadtfeld, M. et al., Induced pluripotent stem cells generated without viral integration. Science. Nov. 7, 2008; 322(5903): 945-949.

Aoi, T. et al., Generation of pluripotent stem cells from adult mouse liver and stomach cells. Science. Aug. 1, 2008; 321(5889): 699-702.

Feng, R. et al., PU.1 and C/EBPalpha/beta convert fibroblasts into macrophage-like cells. Proc Natl Acad Sci USA. Apr. 22, 2008; 105(16): 6057-6062.

PCT Invitation to pay additional fees and, where applicable, protest fee for International application No. PCT/US2013/030061, dated Aug. 22, 2013.

Tripathy, Sandeep et al., Long-term expression of erythopoietin in the systemic circulation of mice after intramuscular injection of a plasmid DNA vector, Proc. Natl. Acad. Sci. USA 93, 1996, pp. 10876-10880.

Yarovoi, Helen et al., Factor VIII ectopically expressed in platelets: efficacy in hemophilia A treatment, Blood Journal, Dec. 1, 2003, olume 102 No. 12, pp. 4005-4013.

PCT Invitation to pay additional fees and, where applicable, protest fee for International application No. PCT/US2013/030062, dated Jul. 19, 2013.

PCT Invitation to pay additional fees and, where applicable, protest fee for International application No. PCT/US2013/030064, dated Jul. 5, 2013.

Parker et al., Targeting of Polyelectrolyte RNA Complexes to Cell Surface Integrins as an Efficient, Cytoplasmic Transfection Mechanism, Journal of Bioactive and Compatible Polymers, Jul. 2002, pp. 1-10.

Kenneth Stanley, Design of Randomized Controlled Trials, Circulation, 2007; 115: pp. 1164-1169.

Chen XL, et al., Expression of human factor IX in retrovirus-transfected human umbilical cord tissue derived mesenchymal stem cells, PubMed, Feb. 2009; 17 (1): 184-87.

Cowling (Jan. 15, 2010, online Dec. 23, 2009, "Regulation of mRNA cap methylation," Biochemical Journal, 425 (Pt 2): 295-302.

Kozak, Marilyn, Regulation of translation via mRNA structure in prokaryotes and eukaryotes, Gene 361 (2005), pp. 13-37.

Fuke, Hiroyuki et al., Role of poly (A) tail as an identity element for mRna nuclear export, Nucleic Acids Research, 2008, vol. 36 No. 3, pp. 1037-1049.

Roger S. Riley, MD, Ph.D., Apr. 2005, http://www.pathology.vcu.edu/clinical/coag/FIX%20Deficiency.pdf, no volume, no pages, no publisher, no journal, 2 pages long.

Seq Search Result 1(U.S. Appl. No. 13/897,362) dated Oct. 11, 2013.

Tracy, M., "Progress in the Development of LNP Delivery for siRNA Advancing LNPs to the Clinic," International Liposome Research Days Meeting, Vancouver, Canada. Aug. 2010, pp. 1-52.

International Search Report from International Application No. PCT/US2013/030064 dated Oct. 21, 2013.

International Search Report from International Application No. PCT/US2013/030062 dated Oct. 21, 2013.

International Search Report and Written Opinion from International Application Serial No. PCT/US2011/54636 dated Apr. 17, 2013.

International Search Report for related application PCT/US2011/46861, Apr. 13, 2012.

International Preliminary Report on Patentability for related application PCT/US2012/031781, Oct. 1, 2013.

International Search Report and Written Opinion from International Application Serial No. PCT/US13/062943 dated Jan. 7, 2014.

Anderson, B.R., et al., Incorporation of pseudouridine into mRNA enhances translation by diminishing PKR activation, Nucleic Acids Res. vol. 38, No. 17, Sep. 1, 2010, pp. 5884-5892.

Kariko, K. et al., Generating the optimal mRNA for therapy: HPLC purification eliminates immune activation and improves translation of nucleoside-modified, protien-encoding mRNA. Nucleic Acids Res. vol. 39, No. 21, Nov. 1, 2011, pp. e142-1, XP002696190.

International Search Report and Written Opinion from International Application Serial No. PCT/US13/030067 dated Dec. 20, 2013.

International Search Report and Written Opinion from International Application Serial No. PCT/US13/030070 dated Dec. 23, 2013.

Love et al., Lipid-like materials for low-dose, in vivo gene silencing, PNAS vol. 107 No. 5, pp. 1864-1869, Feb. 2, 2010.

Mockey et al., mRNA-based cancer vaccine: prevention of B16 melanoma progression and metastasis by systemic injection of MART1 mRNA histidylated lipopolyplexes, Cancer Gene Therapy, 2007, 14, pp. 802-814.

Kwon et al. Molecular Basis for LDL receptor recognition by PCSK9. PNAS. 2008 105(6), 1820-1825.

Bates et al., Detection of Familial Hypercholesterolaemia: A Major Treatment Gap in Preventative Cardiology, Heart, Lung and Circulation 2008;17:411-413.

Garber et al.; A sensitive and convenient method for lipoprotein profile analysis of individual mouse plasma samples. Journal of Lipid Research. 2000. 14: 1020-1026.

Goldstein et al., History of Discovery: The LDL Receptor, Arterioscler Thromb Vasc Biol. Apr. 2009 ; 29(4): 431-438.

Hovingh et al., Diagnosis and treatment of familial hypercholesterolaemia, European Heart Journal (2013) 34, 962-971.

Kobayashi et al., Roles of the WHHL Rabbit in Translational Research on Hypercholesterolemia and Cardiovascular Diseases, Journal of Biomedicine and Biotechnology, vol. 2011, Article ID 406473, pp. 1-10.

(56) References Cited

OTHER PUBLICATIONS

Lambert et al., Thematic Review Series: New Lipid and Lipoprotein Targets for the Treatment of Cardiometabolic Diseases The PCSK9 decade, Journal of Lipid Research vol. 53, 2012 pp. 2515-2524.
Lipari et al., Furin-cleaved Proprotein Convertase Subtilisin/Kexin Type 9 (PCSK9) Is Active and Modulates Low Density Lipoprotein Receptor and Serum Cholesterol Levels. J Biol Chem. 2012, 287(52): 43482-43491.
Surdo et al., Mechanistic implications for LDLreceptor degradation from the PCSK9/LDLR structure at neutral pH, European Molecular Biology Organization, vol. 12 | No. 12 | 2011, pp. 1300-130.
McNutt et al., Antagonism of Secreted PCSK9 Increases Low Density Lipoprotein Receptor Expression in HepG2 Cells. J Biol Chem. 2009. 284(16): 10561-10570.
Ni et al., A PCSK9-binding antibody that structurally mimics the EGF(A) domain of LDL-receptor reduces LDL cholesterol in vivo, Journal of Lipid Research vol. 52, 2011.
Rader et al., Monogenic hypercholesterolemia: new insights in pathogenesis and treatment, J. Clin. Invest. 111:1795-1803 (2003).
Stein et al., Effect of a Monoclonal Antibody to PCSK9 on LDL Cholesterol, N Engl J Med 2012;366:1108-18.
Watts et al., Familial hypercholesterolemia: a missed opportunity in preventive medicine, Nature Clinical Practice, Cardiovascular Medicine, Aug. 2007, vol. 4, No. 8, pp. 404-405.
Zhang et al., Binding of Proprotein Convertase Subtilisin/Kexin Type 9 to Epidermal Growth Factor-like Repeat A of Low Density Lipoprotein Receptor Decreases Receptor Recycling and Increases Degradation, The Journal of Biological Chemistry, Vol. 282, No. 25, pp. 18602-18612, Jun. 22, 2007.
Penheiter et al., Type II Transforming Growth Factor-β Receptor Recycling Is Dependent upon the Clathrin Adaptor Protein Dab2, Molecular Biology of the Cell, vol. 21, 4009-4019, Nov. 15, 2010.
Mulkearns et al., FCHO2 organizes clathrin-coated structures and interacts with Dab2 for LDLR endocytosis, Molecular Biology of the Cell, 2012, pp. 1-28.
Teckchandani et al., The clathrin adaptor Dab2 recruits EH domain scaffold proteins to regulate integrin β1 endocytosis, Molecular Biology of the Cell, 2012, pp. 1-28.
Song et al., A putative role of micro RNA in regulation of cholesterol 7α-hydroxylase expression in human hepatocytes, Nature Biotechnol. 2005, 23:709-717.
Beigneux et al., Human CYP7A1 deficiency: progress and enigmas; The Journal of Clinical Investigation; Jul. 2002, vol. 110, No. 1, pp. 29-31.
Hofman et al., CYP7A1 A-278C Polymorphism Affects the Response of Plasma Lipids after Dietary Cholesterol or Cafestol Interventions in Humans, The Journal of Nutrition, 2004, pp. 2200-2204.
Pullinger et al., Human cholesterol 7α-hydroxylase (CYP7A1) deficiency has a hypercholesterolemic phenotype, J. Clin. Invest 110:109-117 (2002).
Akinc et al., Targeted Delivery of RNAi Therapeutics With Endogenous and Exogenous Ligand-Based Mechanisms, Mol Ther. 2009 17:872-879.
Yamamoto et al., Current prospects for mRNA gene delivery, European Journal of Pharmaceutics and Biopharmaceutics 71 (2009) 484-489.
Trollet et al., Delivery of DNA into muscle for treating systemic diseases: advantages and challenges. Methods Mol. Biol. 2008., 423: 199-214.
International Search Report from International Application No. PCT/US12/38028 dated Aug. 14, 2012.
Lorenzi, J.C., et al., Protein expression from exogenous mRNA: Uptake by receptor-mediated endocytosis and trafficking via the lysosomal pathway. RNA Biology, vol. 8, No. 4, Jul. 1, 2011, pp. 252-258.
International Search Report from International Application No. PCT/US13/54635 dated Mar. 3, 2014.
International Search Report from International Application No. PCT/US13/030070 dated Dec. 23, 2013.
Kassim et al., Gene Therapy in a humanized Mouse Model of Familial Hypercholesterolemia Leads to a Marked Regression of Atherosclerosis, PLOS One, Oct. 2010, vol. 5, Issue 10, pp. e13424.
Supplementary Data from Zhang et al., (J. Biol. Chem 282(25) 18602-12, 2007.
International Search Report from International Application No. PCT/US12/054574 dated Jul. 1, 2013.
NCBI Blast (hyyp://blast.ncbi.nim.nih.gov/Blast.cgi;accession No. BE136127, 2007.
Bell et al., Predisposition to Cancer Caused by Genetic and Functional Defects of Mammalian Atad5, PLOS Genetics, Aug. 2011, vol. 7, Issue 8, e1002245 pp. 1-15.
Gupta et al., Project Report Condon Opitimization, 2003, pp. 1-13.
Whiteside, George, The Orgins and the future of microfluidics, Nautre, vol. 442, Jul. 27, 2006 pp. 368-373.
Pridgen, et al.; Transepithelial Transport of Fc-Targeted Nanoparticles by the Neonatal Fc Receptor for Oral Delivery, Sci Translation Med., vol. 5, Issue 213, Nov. 27, 2013, pp. 1-8.
Nguyen, M. et al., Injectable Biodergradable Hydrogels, Macromolecular Bioscience, 2010,10, 563-579.
Morton, S. Scalable Manufacture of Built-to-Order Nanomedicine: Spray-Assisted Layer-by-Layer Functionalization of PRINT Nanoparticles, Advanced Materials, 2013, 25, 4708-4712.
Li, Z et al., Controlled Gene Delivery System Based pn Thermosensitive Biodegradeable Hydrogel, Pharmaceutical Research, vol. 20, No. 6, Jun. 2003.
Lee, et al.; Thermosensitive Hydrogel as a Tgf-β 1 Gene Delivery Vehicle Enhances Diabetic Wound Healing, Pharmaceutical Research, vol. 20, No. 12, Dec. 2003.
Cu, Y. et al., Enhanced Delivery and Potency of Self-Amplifying mRNA Caccines by Electroporation in Situ, Vaccines, 2013, 1, 367-383.
Chang, C. et al., Non-ionic amphiphilic biodegradable PEG-PLGA-PEG copolymer enhances gene delivery efficiency in rat skeletal muscle; Science Direct, Journal of Controlled Release 118 (2007) 245-253.
Nelson, C. et al., Tunable Delivery of SiRNA from a Biodergradable Scaffold to Promote Angiogenesis In Vivo, Advanced Materials, 2013, pp. 1-8.
Stroock, A. et al., Chaotic Mixer for Microchannels, Science, vol. 295, Jan. 25, 2002, pp. 1-6.
Zangi, L. et al., Modified mRNA directs the fate of heart progenitor cells and indices vasuclar regeneration after myocardial infarction, Nature Biology, Advanced Online Publication, May 10, 2013, pp. 1-9.
Valencia, P. et al. Micoriluidic Platform for Combinatorial Synthesis and Optimization of Targeted Nanoparticles for Cancer Therapy, ACS Nano. Dec. 23, 2013; 7(12):10671-80.
Chen, Y., Self-assembled rosette nanotubes encapsulate and slowly release dexamethasone, International Journal of Nanomedicine, 2011:6 pp. 1035-1044.
Mitragotri, S.; Devices for Overcoming Biological Barriers: The use of physical forces to disrupt the barriers, Advance Drug Delivery Reviews, 65 (2013)100-103.
Wang, X.; Re-evaluating the Roles of Proposed Modulators of Mammalian Target of Rapamycin Complex 1 (mTORCI) Signaling,The Journal of Biological Chemisty, Nov. 7, 2008, vol. 283, No. 45, pp. 30482-30492.
Dreyer Hans C., Leucine-enriched essential amino acid and carbohydrate ingestion following resistance exercise ehances mTOR signaling and protien synthesis in human muscle, AM J. Physiol Endocrinol Metab,; 294; E392-E400,2008.
Lalatsa, Aikaterini, Amphiphilic poly (l-amino acids)—New materials for drug delivery, Journal of Controlled Release, 161 (2012) 523-536.
Stelic Institute & Co., Contract Research Services Specialized in NASH-HCC, Ver.2012.11, 2012, 99.1-10.
Wei, et al. Induction of Broadly Neutralizing H1N1 Influenza Antibodies by Vaccination, Science vol. 329, (2010) pp. 1060-1064.
Palese, P., Making Better Influenza Virus Vaccines?, Emerging Infectious Diseases, vol. 12, No. 1 Jan. 2006, pp. 61-65.

(56) References Cited

OTHER PUBLICATIONS

Kwong, P. et al., Broadly Neutralizing Antibodies and the Search for an HIV-1 Vaccine: The End of the Beginning, Nature Reviews, Immumology, vol. 13, Sep. 2013, pp. 693-701.
DeMarco, et al., A Non-VH1-69 Hetetrosubtypic Neutrilizing Human Minoclonal Antibody Protects Mice Against H1N1 and H5N1 Viruses, PLOS One, Apr. 2012, vol. 7, Issue 4, pp. 1-9.
Anderson, et al. The Bridge, National Academy of Engineering of the National Academies, Fall 2006, vol. 36., No. 3, pp. 1-55.
EP11830061, Supplementary Search Report, Mar. 18, 2014.
Hoerr, I. et al., In vivo application of RNA leads to induction of specific cytotoxic T lymphocytes and antibodies. Eur J Immunol. Jan. 2000;30(1):1-7.
Hoerr, I. et al., Stabilized Messenger RNA (RNActiveTM) as a Tool for Innovative Gene Delivery. Tissue Engineering. Apr. 2007; 13(4): 865-925.
Holcik, M. et al., Four highly stable eukaryotic mRNAs assemble 3' untranslated region RNA-protein complexes sharing cis and trans components. oc Natl Acad Sci U S A. Mar. 18, 1997;94(6):2410-4.
Holmes, D. et al., Cell positioning and sorting using dielectrophoresis. Eur Cell Mater. 2002; 4(2):120-2.
Holtkamp, S. et al., Modification of antigen-encoding RNA increases stability, translational efficacy, and T-cell stimulatory capacity of dendritic cells. Blood. Dec. 15, 2006;108(13):4009-17.
Houghton, A.N. et al., Cancer antigens: immune recognition of self and altered self. J Exp Med. Jul. 1, 1994;180(1):1-4.
Hsu, F.J. et al., Vaccination of patients with B-cell lymphoma using autologous antigen-pulsed dendritic cells. Nat Med. Jan. 1996;2(1):52-8.
Hu, B., et al., Neural differentiation of human induced pluripotent stem cells follows developmental principles but with variable potency. Natl Acad Sci. Mar. 2010; 107(9): 4335-4340.
Hu, S. et al., Codon optimization, expression, and characterization of an internalizing anti-ErbB2 single-chain antibody in Pichia pastoris. Protein Expr Purif. May 2006;47(1):249-57. Epub Dec. 13, 2005.
Huangfu, D., et al., Induction of pluripotent stem cells by defined factors is greatly improved by small-molecule compounds. Nat Biotech. Jul. 2008; 26(7) 795-797.
Huddleston, J.A. et al., The sequence of the nucleoprotein gene of human influenza A virus, strain A/NT/60/68. Nucleic Acids Res. Feb. 11, 1982;10(3):1029-38.
Hue, K.K. et al., A polypurine sequence that acts as a 5' mRNA stabilizer in Bacillus subtilis. J Bacteriol. Jun. 1995;177(12):3465-71.
Hung, C.F. et al., Ovarian cancer gene therapy using HPV-16 pseudovirion carrying the HSV-tk gene. PLoS One. Jul. 2012; 7(7): e40983.
Inaba, K. et al., Dendritic cells pulsed with protein antigens in vitro can prime antigen-specific, MHC-restricted T cells in situ. J Exp Med. Aug. 1, 1990;172(2):631-40.
Inaba, K. et al., Direct activation of CD8+ cytotoxic T lymphocytes by dendritic cells. J Exp Med. Jul. 1, 1987;166(1):182-94.
Inaba, K. et al., Generation of large numbers of dendritic cells from mouse bone marrow cultures supplemented with granulocyte/macrophage colony-stimulating factor. J Exp Med. Dec. 1, 1992;176(6):1693-702.
International Search Report from International Application No. PCT/US11/54617 dated Oct. 3, 2011.
International Search Report from International Application No. PCT/US11/54617 dated Feb. 1, 2012.
International Search Report from International Application No. PCT/US2012/031781 dated Jan. 11, 2013.
International Search Report from International Application No. PCT/US12/54561 dated Feb. 26, 2013.
International Search Report from International Application No. PCT/US12/58519 dated Feb. 28, 2013.
International Search Report from International Application No. PCT/US12/68732 dated Feb. 22, 2013.
International Search Report from International Application No. PCT/US12/69610 dated Feb. 27, 2013.
International Search Report from International Application No. PCT/US12/71105 dated Mar. 5, 2013.
International Search Report from International Application No. PCT/US13/20921 dated Mar. 26, 2013.
International Search Report from International Application No. PCT/US12/71118 dated Apr. 5, 2013.
Ito, M.K., ISIS 301012 gene therapy for hypercholesterolemia: sense, antisense, or nonsense? Ann Pharmacother. Oct. 2007; 41(10): 1669-78.
Ivanovska, N. et al., Immunization with a DNA chimeric molecule encoding a hemagglutinin peptide and a scFv CD21-specific antibody fragment induces long-lasting IgM and CTL responses to influenza virus. Vaccine. Mar. 10, 2006;24(11):1830-7. Epub Nov. 2, 2005.
Iwasaki, A. et al., Enhanced CTL responses mediated by plasmid DNA immunogens encoding costimulatory molecules and cytokines. J Immunol. May 15, 1997;158(10):4591-601.
Jady, B.E. et al., a small nucleolar guide RNA functions both in 2'-O-ribose methylation and pseudouridylation of the U5 spliceosomal RNA. EMBO J. Feb. 1, 2001;20(3):541-51.
Janeway, C. et al., Immunobiology: the immune system in health and disease. Garland Publishing, Inc, London. 1997; 13:12-13:21.
Jansen, P.L.M., Diagnosis and management of Crigler-Najjar syndrome. Eur J Pediatr. Dec. 1999;158 [Suppl 2]:S89-S94.
Janssens, S. et al., Role of Toll-like receptors in pathogen recognition. Clin Microbiol Rev. Oct. 2003;16(4):637-46.
Jemielity, J. et al., Novel "anti-reverse" cap analogs with superior translational properties. RNA. Sep. 2003;9(9):1108-22.
Jia, F., et al., A nonviral minicircle vector for deriving human iPS Cells. Nat Methods. Mar. 2010; 7(3): 197-199.
Jia, Z., et al., Long-term correction of hyperbilirubinemia in the Gunn Rat by repeated intravenous delivery of naked plasmid DNA into muscle. Mol Ther. Nov. 2005; 12(5): 860-866.
Jiang, J. et al., Topical application of ketoconazole stimulates hair growth in C3H/HeN mice. J Dermatol. Apr. 2005;32(4):243-7.
Jirikowski, G.F., et al., Reversal of diabetes insipidus in Brattleboro Rats: Intrahypothalamic injection of vasopressin mRNA. Science. Feb. 1992; 255(5047): 996-998.
Johnson, K.M. et al., Role of heparan sulfate in attachment to and infection of the murine female genital tract by human papillomavirus. J Virol. Mar. 2009; 83(5): 2067-2074.
Jones, P.C.T., An Alteration in Cell Morphology under the Influence of a Tumor RNA. Nature, 1964;202:1226-7.
Juliano, R.L., et al., Cell-targeting and cell-penetrating peptides for delivery of therapeutic and imaging agents. Wiley Interdisciplinary Reviews: Nanomedicine and Nanobiotechnology. May/Jun. 2009; 1(3): 324-335.
Kabanov, A.V. et al., A new class of antivirals: antisense oligonucleotides combined with a hydrophobic substituent effectively inhibit influenza virus reproduction and synthesis of virus-specific proteins in MDCK cells. FEBS Lett. Jan. 1, 1990;259(2):327-30.
Kahan, F.M. et al., The role of deoxyribonucleic acid in ribonucleic acid synthesis. J Biological Chem. Dec. 1962; 287(12): 3778-3785.
Kaji, K., et al., Virus free induction of pluripotency and subsequent excision of reprogramming factors. Nature. Apr. 2009; 458(7239): 771-775.
Kalnins, A. et al., Sequence of the IacZ gene of *Escherichia coli.* EMBO J. 1983;2(4):593-7.
Kanaya, S. et al., Codon usage and tRNA genes in eukaryotes: correlation of codon usage diversity with translation efficiency and with CG-dinucleotide usage as assessed by multivariate analysis. J Mol Evol. Oct.-Nov. 2001;53 (4-5):290-8.
Kandimalla, E.R. et al., Divergent synthetic nucleotide motif recognition pattern: design and development of potent immunomodulatory oligodeoxyribonucleotide agents with distinct cytokine induction profiles. Nucleic Acids Res. May 1, 2003;31(9):2393-400.
Kandimalla, E.R. et al., Immunomodulatory oligonucleotides containing a cytosine-phosphate-2'-deoxy-7-deazaguanosine motif as potent toll-like receptor 9 agonists. Proc Nati Acad Sci U S A. May 10, 2005;102(19):6925-30. Epub Apr. 28, 2005.

(56) References Cited

OTHER PUBLICATIONS

Karande, A.A.,et al., In vitro induction of chronic myeloid leukemia associated immune reactivity in normal human lymphocytes by xenogeneic immune RNA. Neoplasma, 1983, 30(4):403-9.
Iwase, Reiko et al., Molecular design of a eukaryotic messenger RNA and its chemical synthesis, Nucleic Acids Research, 1991, vol. 20, No. 7, pp. 1643-1648.
Squires, Jeffrey et al., Widespread occurrence of 5-methylcytosine in human coding an non-coding RNC, Nucleic Acids Research, 2012, vol. 40, No. 11, pp. 5023-5033.
Wyatt, et al., Occurrence of 5-Methyl-Cytosine in Nucleic Acid, 1950, vol. 166, No. 4214, pp. 237-238.
Chen, Chun et al., A Flexible RNA Backbone within the Polypyrimidine Tract Is Required for U2AF65 Binding and Pre-mRNA Splicing In Vivo, Molecular and Cellular Biology, 2010, vol. 30, No. 17, pp. 4108-4119.
Wantabe, Hiroshi, et al., Conformational Stability and Warfarin-Binding Properties of Human Serum Albumin Studied by Recombinany Mutants, Biochem. J., 2001, vol. 357, No number, pp. 269-274.
Abramova, Tatyana, Frontiers and Approaches to Chemical Synthesis of Oligodeoxyribonucleotides, Molecules 2013, vol. 57, No. 18, 1063-1075.
Bonora, G. et al., HELP (High Efficiency Liquid Phase) new oligonucleotide synthesis on soluble polymeric support, Oxford Journals Life Sciences Nucleic Acids Research vol. 18, Issue 11 pp. 3155-3159.
Borovkov, A. Et al., High-Quality Gene Assembly Directly From Unpurified Mixtures of Microarray-Synthesized Oligonucleotides, Nucleic Acids Research, 2010, vol. 38, No. 19, pp. e180 1-10.
Cheng, S. et al. Effective Amplification of Long Targets From Cloned Inserts and Hunam Genomic DNA, Proc. Nati. Acad. Sci. USA,1994, vol. 91, pp. 5695-5699.
Cleary, Michele et al., Production of Complex nucleic acid libraries using highly parallel in situ oligonucleotide synthesis, 2004, Nature Methods vol. 1 No. 3, Dec. 2004, pp. 241-248.
El-Sagheer, Afaf H. et al., Click Nucleic Acid Ligation: Applications in Biology and Nanotechnology, Accounts of Chemical Research, 2012 vol. 45, No. 8, pp. 1258-1267.
Freeman, Willard M. et al., Quantitative RT-PCR: Pitfalls and Potential, BioTechniques, 1999, vol. 26, No. 1, pp. 112-125.
Gibson, D. et al., Creation of a Bacterial Cell Controlled by a Chemically Synthesized Genome, Science, 2010, vol. 329, No. 52, pp. 51-56.
Gibson, Daniel G., Chemical Synthesis of the Mouse Mitochondrial Genome, Nature Methods , vol. 7., No. 11 Nov. 2010, pp. 901-905.
Goodchild, John et al., Conjugates of Oligonucleotides and Modified Oligonucleotides: A Review of Their Synthesis and Properties, Bioconjugate Chemistry, 1990, vol. 1., No. 3., pp. 165-187.
Innis, M., DNA Sequencing with Thermus Aquaticus DNA Polymerase and Direct Sequencing of Polymerase Chain Reaction-Amplified DNA, Proc. Natl. Acad. Sci. USA, 1988, vol. 85, pp. 9436-9440.
Kang, Hyunmin, Inhibition of MDR1 Gene Expression by Chimeric HNA Antisense Oligonucleotides, Nucleic Acids Research, 2004, vol. 32, No. 14, pp. 4411-4419.
Lavrik, Inna N. et al., Translational Properties of mHNA, a Messenger RNA Containing Anhydrohexitol Nucleotides, Biochemistry 2001, vol. 40, No. 39, pp. 11777-11784.
Li, Junjie, et al.; Methylation Protects miRNAs and siRNAs from a 3_-End Uridylation Activity in Arabidopsis, Current Biology, 2005, vol. 15, (no number), pp. 1501-1507.
Lizardi, PM., et al., Mutation Detection and Single-Molecule Counting Using Isothermal Rolling-Circle Amplification, Nat Genetics, 1998, vol. 19, No #, pp. 225-232.
Martinelli, Richard A., Chemiluminescent Hybridization-Ligation Assays for F508 and I507 Cystic Fibrosis Mutations, Clinical Chemistry, 1996, vol. 42., No. 1, pp. 14-18.
Moore, M., Site-Specific Modification of Pre-mRNA: The 2"-Hydroxyl Groups at the Splice Sites, Science, 1992, vol. 256, No #, pp. 992-997.
Nagata, S., Synthesis and Biological Activity of Artificial mRNA Prepared with Novel Phosphorylating Reagents, Nucleic Acids Research, 2010, vol. 38, No. 21, pp. 7845-7857.
Norbury, Chris J., Cytoplasmic RNA: A Case of the Tail Wagging the Dog, Nature Reviews, Molecular Cell Biology, 2013, Advanced Online Publication, No Volume Number, pp. 1-10.
Nwe, K. et al., Growing Applications of "Click Chemistry" for Bioconjugation in Contemporary Biomedical Research, Cancer Biotherapy and Radiopharmaceuticals, 2009, vol. 24., No. 3., pp. 289-301.
Ochman, H., Genetic Applications of an Inverse Polymerase Chain Reaction, Genetics, Washington University School of Medicine, 1988, vol. 120, No #, pp. 621-623.
Polidoros, A. et al., Rolling Circle Amplification—RACE: a method for Simultaneous Isolation of 5" and 3" cDNA ends from Amplified cDNA templates, Benchmarks, Biotechniques, 2006, vol. 41, No. 1, pp. 35-42.
Pon, R., Multiple Oligodeoxyribonucleotide Syntheses on a Reusable Solid-Phase CPG Support via the Hydroquinone-O, O"-diacetic acid (Q-Linker) linker arm, Nucleic Acids Research, 1999, vol. 27, No. 6, pp. 1531-1538.
Shiba, Y. et al., Chemical Synthesis of a Very Long Oligoribonucleotide with a 2-cyanoethoxymethyl (CEM) as the 2'-O-protecting Group: Structural Identification and Biological Activity of a Synthetic 110mer precursor-microRNA Candidate, Nucleic Acids Research, 2007, vol. 35, No. 10, pp. 3287-3296.
Sindelar, L. et al., High-throughput DNA Synthesis in a Multichannel Format, Nucl. Acids Res. 1995, vol. 23, No. 6, pp. 982-987.
Stark, M. et al., An RNA Ligase-mediated Method for the Efficient Creation of Large, Synthetic RNAs, Method, 2006, vol. 12, No Vol. number, pp. 2014-2019.
Walker, T., Isothermal In Vitro Amplification of DNA by a Restriction Enzyme/ DNA Polymerase System, Proc. Natl. Acad. Sci. USA, 1992, vol. 89, No number, pp. 392-396.
Zhu, B., Syn5 RNA Polymerase Synthesizes Precise Run-Off RNA Products, Nucleic Acids Research, 2013, vol. 103, No #, pp. 1-10.
Prokazyme Ltd., ThermoPhage, ssDNA ligase,2013, No Vol. pp. 1-3.
Prokaria LTD, Tsc DNA ligase, 2013, No Vol., pp. 1-3.
Bolhassani A., et al. , Improvement of Different Vaccine Delivery Systems for Cancer Therapy, Molecular Cancer, Biomed Central, London, GB, 2011, vol. 10, No. 3, pp. 1-20.
Cheng, Ee-chun et al., Repressing the Repressor: A lincRNA as a MicroRNA Sponge in Embryonic Stem Cell Self-Renewal, Developmental Cell, 2013, vol. 25, No number, pp. 1-2.
Memczak, Sebastian et al. , Circular RNAs are a large class of animal RNAs with Regulatory Potency, Nature, 2013, vol. 495, no number, pp. 333-343.
Hentze, M., Circular RNAs: Splicing's Enigma Variations, The EMBO Journal, 2013, vol. 32, no number, pp. 923-925.
Salzman, Julia et al., Circular RNAs Are the Predominant Transcript Isoform From Hundreds of Human Genes in Diverse Cell Types, PLOS One, 2012, vol. 7, Issue 2, pp. 1-12.
Ebert, Margaret S., MicroRNA sponges: Competitive Inhibitors of Small RNAs in Mammalian Cells, Nature Methods, 2007, vol. 4, No. 9, pp. 721-726.
Jeck, William et al. Circular RNAs Are Abundant, Conserved, and Associated with ALU Repeats, RNA, 2013, vol. 19, pp. 141-157.
Matsuda, V. et al., Determinants of Initiation Codon Selection During Translation in Mammalian Cells, PLOS One, 2010, vol. 5, Issue 11, pp. 1-13.
Mukherji, S. et al., MicroRNAs Can Generate Thresholds in Target Gene Expression, Nature Genetics, 2011, vol. 43, No. 9, pp. 854-860.
Hansen, Thomas et al., Natural RNA Circles Function As Efficient MicroRNA Sponges, Nature, 2013, vol. 495, no number, pp. 384-390.
Rose, Jason, MicroRNA "Sponge": Proof of Concept for a Novel MicroRNA Target Identification Technique, A Major Qualifying Project Report, Submitted to the Faculty of Worcester Polytechnic Institute, 2010, No Volume, pp. 1-26.

(56) References Cited

OTHER PUBLICATIONS

Touriol, C. et al Generation of Protein Isoform Diversity by Alternative Initiation of Translation at Non-AUG Codons, Biology of the Cell, 2003, vol. 95, no number, pp. 168-178.
Wang et al., Endogenous miRNA Sponge lincRNA-RoR Regulates Oct4, Nanog, and Sox2 in Human Embryonic Stem Cell Self-Renewal, Developmental Cell, 2013, vol. 25, No #, pp. 69-80.
Agadjanyan, M., Prototype Alzheimer's Disease Vaccine Using the Immunodominany B Cell Type from β-Amloid and Promiscuous T Cell Epitope Pan HLA DR-Binding Peptide, J Immunol, 2005, vol. 174, no number, pp. 1580-1586.
Davtyan, H. et al., Immunogenicity, Efficacy, Safety, and Mechanism of Action of Epitope Vaccine (Lu AF20513) for Alzheimer's Disease: Prelude to a Clinical Trial, The Journal of Neuroscience, Mar. 2013, vol. 33, No. 11, pp. 4923-4934.
Zwick, M. et al., Identification and Characterization of a Peptide That Specifically Binds the Human, Broadly Neutralizing Anti-Human Immunodeficiency Virus Type 1 Antibody b12, Journal of Virology, Jul. 2001, vol. 75, No. 14, pp. 6692-6699.
Zwick, M. et al., Molecular Features of the Broadly Neutralizing Immunoglobulin G1, b12 Required for Recognition of Human Immunodeficiency Virus Type 1 gp120, Journal of Virology, 2003, vol. 77, No. 10, pp. 5863-5876.
Wilkinson, R. et al., Structure of the Fab Fragment of F105, a Broadly Reactive Anti-Human Immunodeficiency Virus (HIV) Antibody that Recognizes the CD4 Binding Site of HIV type 1 gp120, Journal of Virology, 2005, vol. 79, No. 20, pp. 13060-13069.
Julien, Jean-Philippe et al., Broadly Neutralizing Antibody PGT121 Allosterically Modulates CD4 Binding via Recognition of the HIV-1 gp120 V3 Base and Multiple Surrounding Glycans, PLOS Pathogens, 2013, vol. 9, Issue 5, pp. 1-15.
Laursen, N. et al., Broadly Neutralizing Antibodies Against Influenza Viruses, Antiviral Research, 2013, vol. 98, no number, pp. 476-483.
Barouch, Dan et al., Therapeutic Efficacy of Potent Neutralizing HIV-1-specific monoclonal Antibodies in SHIV-infected Rehesus Monkeys, Nature, 2013, vol. 503, No. 7475, pp. 224-228.
Shingai, M. et al., Antibody-mediated Immunotherapy of Macaques Chronically Infected with SHIV Suppresses Viraemia, Nature, 2013, vol. 503, No. 7475, pp. 277-80.
Balaza, Alejandro et al., Vectored Immunoprophylaxis Protects Humanized Mice from Mucosal HIV Transmission, Nature Medicine, 2014, vol. 3, pp. 296-300.
Burton, Dennis et al., A Large Array of Human Monoclonal Antibodies to Type 1 Human Immunodefiency Virus From Combinatorial Libraries of Asymptomatic Seropositive Individuals, Proc. Nati Acad., USA,1991, vol. 88, No Number, pp. 10134-10137.
Burton, Dennis et al., Efficient Neutralization of Primary Isolates of HIV-1 by a Recombinant Human Monoclonal Antibody, Science, 1994, vol. 266, No Number, pp. 1024-1027.
Scheid, Johannes et al., Sequence and Structural Convergence of Broad and Potent HIV Antibodies That Mimic CD4 Binding, Science , 2011, vol. 333, No Number, 1633-1637.
Ledford, H., Supercharged Antibodies Fight HIV-Related Virus in Monkeys, Nature, 2013, No Volume, pp. 1-2.
Delehanty, James B., Peptides for Specific Intracellular Delivery and Targeting of Nanoparticles: Implications for Developing Nanoparticle-Mediated Drug Delivery, Future Science, Therapeutic Delivery, 2010, vol. 1, No. 3, pp. 411-433.
Dharap, S.S., et al., Tumor-specific Targeting of an Anticancer Drug Delivery System by LHRH Peptide, PNAS, 2005, vol. 102, No. 36, pp. 12962-12967.
Du, L. et al., Arginine-rich cell-penetrating peptide dramatically enhances AMO-mediated ATM Aberrant Splicing Correction and Enables Delivery to Brain and Cerebellum, Human Molecular Genetics, 2011, vol. 20, No. 16, pp. 3151-3160.
Ezzat, Kariem et al. PepFect 14, a Novel Cell-penetrating Peptide for Oligonucleotide Deliver in Solution and As Solid Formulation, Nucleic Acids Research, 2011, vol. 39, No. 12, pp. 5284-5298.

Fang, Shun-lung et al., A Novel Cell-Penetrating Peptide Derived from Human Eosinophil Cationic Protein, PLOS One, 2013, vol. 8, Issue 3, pp. 1-13.
Giblin, M. et al., Selective Targeting of *E. coli* Heat-stable Enterotoxin Analogs to Human Colon Cancer Cells, Anticancer Research, 2006,vol. 26, No number, pp. 3243-3252.
Kelly, Kimberley et al. , Isolation of a Colon Tumor Specific Binding Peptide Using Phage Display Selection, Neoplasia, 2003, vol. 5, No. 5, pp. 437-444.
Knowles, Lynn et al., CLT1 Targets Angiogenic Endothelium through CLIC1 and Fibronectin, Angiogenesis, 2012, vol. 15, No. 1, pp. 115-129.
Laakkonen, Pirjo et al., Homing Peptides as Targeted Delivery Vehicles, Interactive Biology, 2010, vol. 2, No number, pp. 326-337.
Li, Zhi Jie, et al., Peptides as Targeting Probes Against Tumor Vasculature for Diagnosis and Drug Delivery, Journal of Translational Medicine, 2012, vol. 10 , Supp 1, No. s1, pp. 1-9.
Lin, Jieru et al., Bacterial Heat-Stable Enterotoxins: Translation of Pathogenic Peptides into Novel Targeted Diagnostics and Therapeutics, Toxins, 2010, vol. 2, No number, pp. 2028-2054.
Lo, Albert et al., Hepatocellular Carcinoma Cell-Specific Peptide Ligand for Targeted Drug Delivery, Molecular Cancer Therapeutics, 2008, vol. 7 , No. 3, pp. 579-589.
Lu, Ruei-Min et al., Targeted Drug Delivery Systems Mediated by a Novel Peptide in Breast Cancer Therapy and Imaging, PLOS One, 2013, vol. 8, Issue 6, pp. 1-13.
Pangburn, Todd et al., Peptide- and Aptamer-Functionalized Nanovectors for Targeted Delivery of Therapeutics, Journal of Biomedical Engineering, 2009, vol. 131, No number, pp. 1-20.
Phelan, Anne et al., Intercellular Delivery of Functional p53 by the Herpesvirus Protein VP22, Nature Biotechnology , 1998, vol. 16, pp. 440-443.
Laakkonen, Pirjo et al., Homing Peptides as Targeted Delivery Vehicles, Integrative Biology, 2010, vol. 2, no number, pp. 326-337.
Regberg, Jakob et al., Applications of Cell-Penetrating Peptides for Tumor Targeting and Future Cancer Therapies, Pharmaceuticals, 2012, vol. 5, No number, pp. 991-1007.
Suchanek, Gerda et al., Amino Acid Sequence of Honeybee Prepromelittin Synthesized in Vitro, Proc. Natl. Acad. Sci. USA,1978, vol. 75, No. 2, pp. 701-704.
Torchilin, Vladimir et al., Multifunctional and Stimuli-Sensitive Pharmaceutical Nanocarriers, Eur J. Pharm Biopharm, 2009, vol. 71, No. 3, pp. 431-444.
Yang, Xiaoming, et al., Effect of CD44 Binding Peptide Conjugated to an Engineered Inert Matrix on Maintenance of Breast Cancer Stem Cells and Tumorsphere Formation, PLOS One, 2013, vol. 8, Issue 3, pp. 1-15.
Zou, Li-li et al., Cell-Penetrating Peptide-Mediated Therapeutic Molecule Delivery Into the Central Nervous System, Current Neuropharmacology, 2013, vol. 11, No. 2, pp. 197-208.
Baars, A. et al., A Phase II Study of Active Specific Immunotherapy and 5-FU/Leucovorin as Adjuvant Therapy for Stage III Colon Carcinoma, British Journal of Cancer, 2002, vol. 86, No. 8, pp. 1230-1234.
Badawi, Ahmed, et al. , Immune Modulating Peptide for the Treatment and Suppression of Multiple Sclerosis, Clin Immunol, 2012, vol. 144, No. 2, pp. 127-138.
Bandala-Sanchez, Esther et al., T cell Regulation Mediated by Interaction of Soluble CD52 with the Inhibitory Receptor Siglec-10, Nature Immunology, 2013, vol. 14, No. 7, pp. 741-751.
Lu, Changming et al., miR-221 and miR-155 Regulate Human Dendritic Cell Development Apoptosis, and IL-12 Production Through Targeting of p27kip1, KPC1 and SOCS-1, Blood, 2001, vol. 117, No. 16, pp. 4293-4303.
Chang, C et al., Tolerization of Dendritic Cells by Ts cells: The Crucial Role of Inhibitory Receptors ILT3 and ILT4, Nature Immunology, 2002, vol. 3, No. 3, pp. 237-243.
Cheng, Guotan et al., T Cell Tolerance and the Multi-Functional Role of IL-2R Signalling in T Regulatory Cells, Immunol Rev., 2011, vol. 241, No. 1, pp. 63-76.

(56) References Cited

OTHER PUBLICATIONS

Cools, Nathalie, et al., Balancing Between Immunity and Tolerance: an Interplay Between Dendritic Cells, Regulatory T Cells, and Effector T Cells, Journal of Leukocyte Biology, 2007, vol. 82, pp. 1365-1374.
Cousens, Leslie et al., Tregitope Update: Mechanism of Action Parallels IVIg, Autoimmunity Reviews, 2012, No Volume, pp. 1-8.
Cousens, L. et al., In Vitro and In Vitro Studies of IgC-derived Treg Epitopes (Tregitopes): A Promising New Tool for Tolerance Induction and Treatment of Autoimmunity, J. Clin. Immunol, 2013, vol. 33, Supp 1, pp. 43-49.
Cousens, Leslie et al., Application of IgC-Derived Natural Treg Epitopes (IgG Tregitopes) to Antigen-Specific Tolerance Induction in a Murine Model of Type 1 Diabetes, Journal of Diabetes, vol. 2013, Article ID 621693, pp. 1-17.
Danke, Nancy et al., Comparative Study of GAD65-specific CD4+ T cells in healthy and Type 1 Diabetic Subjects, Journal of AutoImmunity, 2005, vol. 25, No Number, 303-311.
DeGroot, Anne S. et al., Activation of Natural Regulatory T cells by IgG F-derived peptide "Tregitopes", 2008, vol. 112, No. 8, pp. 3303-3311.
DiCaro, Valentina, et al., In Vivo Delivery of Nucleic Acid-Formulated Microparticles as a Potential Tolerogenic Vaccine for Type 1 Diabetes, 2012, vol. 9, No. 4, pp. 348-356.
EMEA, Committee for Medicinal Products for Human Use, European Medicines Agency, 2008, No Vol. pp. 1-13.
Evel-Kabler, Kevin et al., SOCS1 Restricts Dendritic Cells' Ability to Break Self Tolerance and Induce Antitumor Immunity by Regulating IL-12 Production and Signaling, The Journal of Clinical Investigation, 2006, vol. 116, No. 1, pp. 90-100.
Finn, Jonathan et al., Eradication of Neutralizing Antibodies to Factor VIII in Canine Hemophila A After liver Gene Therapy, Blood, 2010, vol. 116, No. 26, pp. 5842-5848.
Han, Shuhong et al., Novel Autoantigens in Type 1 Diabetes, Am J Transl Res, 2013, vol. 5, No. 4, pp. 379-392.
High, Katherine, et al. The Gene Therapy Journey for Hemophilia: Are We There Yet?, Blood, 2012, vol. 120, No. 23, pp. 4482-4487.
Hoffman, Brad et al., Nonredundany Roles of IL-10 and TGF-β in Supression of Immune Responses tp Hepatic AAV-Factor IX Gene Transfer, The American Society of Gene and Cell Therapy, 2011, vol. 19, No. 7, pp. 1263-1272.
Hopkins, Benjamin et al., A Secreted PTEN Phosphatase That Enters Cells to Alter Signaling and Survival, Science, 2013,vol. 341, No. 399, pp. 399-341.
Takahashi, R. et al., SOCS1 is Essential for Regulatory T Cell Functions by Preventing Loss of Foxp3 Expression as Well AsIFN-y and IL-17A Production, The Journal of Experimental Medicine, 2011, vol. 208, No. 10, pp. 2055-2067.
Jacobsen, Lars et al., Allergen-specific Immunotherapy Provide Immediate, Long-Term and Preventive Clinical Effects in Children and Adults: The Effects of Immunotherapy Can be Categorised by Level of Benefit—the centenary of Allergen Specific Subcutaneous Immunotherapy, Clinical and Translational Allergen, 2012, vol. 2, No. 8, pp. 1-11.
Kinjyo, Ichiko et al., SOCS1/JAB is a Negative Regulator of LPD-Induced Macrophage Activation, Immunity, 2002, vol. 17, No number, pp. 583-591.
LoDuca, Paul et al., Hepatic Gene Transfer as a Means of Tolerance Induction to Transgene Products, Curr Gene Ther. 2009, vol. 9, No. 2, pp. 104-114.
Lu, Li-Fan et al., Foxp3-Dependent MicroRNA 155 Confers Competitive Fitness to Regulatory T Cells by Targeting SOCS1 Protein, CellPress, Immunity, 2008, No Volume Number, pp. 80-91.
Luo, Xunrong et al., Dendritic Cells with TGF-B1 Differentiate naïve CD4=CD25-T Cells Into Islet-Protective Foxp3+ Regulatory T Cells, PNAS, 2007, vol. 104, No. 8, pp. 2821-2826.
Mingozzi, Federico, et al., Pharmacological Modulation of Humoral Immunity in a Nonhuman Primate Model AAV Gene Transfer for Hemophilia B, The American Society of Gene & Cell Therapy, 2012, vol. 20, No. 7, pp. 1410-1416.

Peakman, Mark et al., Can We Vaccinate Against Type 1 Diabetes, F1000Reports Biology, 2012, No Volume no., pp. 1-8.
Roep, Bart et al., Antigen Targets of Type 1 Diabetes Autoimmunity, Cold Spring Harbor Perspectives in Medicine, 2013, No Vol., pp. 1-15.
Suciu-Foca, Nicole et al., Soluble IG-Like Transcript 3 Inhibits Tumor Allograft Rejection in Humanized SCID Mice and T Cell Responses in Cancer Patients, The Journal of Immunology, 2007, vol. 178, pp. 4732-7441.
Vlad, George et al., Immunoglobulin-Like Transcript 3-FC Suppresses T-Cell Responses to Allogeneic Human Islet Transplants in hu-NOD/SCID Mice, Diabetes, 2006, vol. 57, No number, pp. 1-9.
Wantabee, Hisayo et al., Experimental Autoimmune Thyroiditis Induced b Thyroglobulin-Pulsed Dendritic Cells, 1999, vol. 31, No. 4, pp. 273-282.
Wing, Kajsa et al., Regulatory T Cells Exert Checks and Balances on Self Tolerance and Autoimmunity, Nature Immunology, 2010, vol. 11, No. 1, pp. 1-8.
Yang, Junbao et al., Cd+Tcells from Type 1 Diabetic and Healthy Subjects Exhibit Different Thresholds of Activation to a Naturally Processed Proinsulin Epitope, Journal of Autoimmunity, 2008, vol. 31, No Vol. number, pp. 30-41.
Taniguchi, Takashi et al., Serum Levels of Galectin-3: Possible Association with Fibrosis, Aberrant Angiogenesis, and Immune Activation in Patients with Systemic Sclerosis, The Journal of Rheumatology, 2012, vol. 39, No. 3, pp. 539-544.
Chen, Juine-Ruey, et al., Vaccination of Monoglycosylated Hemagglutinin Induces Cross-Strain Protection Against Influenza Virus Infection, PNAS, 2013, No Volume Number, pp. 1-6.
Apostolopoulos, Vasso et al. , Targeting Antigens to Dendritic Cell Receptors for Vaccine Development, Hindawi Publishing Corporation Journal of Drug Delivery, 2013, vol. 201, Article ID 869718, pp. 1-22.
Deering, Raquel et al., Nucleic Acid Vaccines: Prospects for Non-Viral Delivery of mRNA Vaccines, Expert Opinion, 2014, vol. 11, No. 6, pp. 1-15.
Falugi, Fabiana et al., Role of Protien A in the Evasion of Host Adaptive Immune Responses by *Staphylococcus aureus*, mBio, 2014, vol. 4, Issue 5, pp. 1-10.
Geijtenbeek, Teunis et al., Identification of DC-SIGN, A Novel Dendritic Cell-Specific ICAM-3 Receptor That Supports Primary Immune Responses, Cell, 2000, vol. 100, pp. 575-585.
World Health Organization, Department of Communicable Disease Surveillance and Response, WHO/CSR, 2000, Chapter 7, pp. 1-7.
Gupta, Shivali et al., TcVac3 Induced Control of Trypanosoma Cruzi Infection and Chronic Myocarditis in Mice, PLOS One, 2013, vol. 8, Issue 3, pp. 1-16.
Nogueira, Raquel et al., Recombinant Yellow Fever Viruses Elicit CD8+ T Cell Responses and Protective Immunity Against Trypanosoma Cruzi, PLOS One, 2013, vol. 8, Issue 3, pp. 1-13.
Barr, Ian et al., Epidemiological, Antigen and Genetic Characteristics of Seasonal Influenza a(H1N1), A (H3N2) and B Influenza Virus: Basis for WHO Recommendation on the Competition of Influenza Vaccines for Using in the 2009-2010 Northern Hemisphere Season, Vaccine, 2010, vol. 28, No number, pp. 1156-1167.
Kim, Hwan Keun et al., Nontoxigenic Protein A Vaccine for Methicillin-Resistant *Staphylococcus aureus* Infections in Mice, The Journal of Experimental Medicine, 2010, vol. 207, No. 9, pp. 1863-1870.
Lee, Justin B. et al., Lipid Nanoparticle siRNA Systems for Silencing the Androgen Receptor in Human Prostate Cancer in Vivo, International Journal of Cancer, 2012, vol. 131, pp. 781-790.
Brandenburg, Boerries et al., Mechanisms of Hemagglutinin Targeted Influenza Virus Neutralization, PLOS One, 2013, vol. 8, Issue 12, pp. 1-14.
Messer, William B. et al., Dengue Virus Envelope Protein Domain I/II Hinge Determines long-livid Serotype-Specific Dengue Immunity, PNAS, 2014, vol. 111, No. 5, 1939-1944.
Metz, Bernard et al, Identification of Formaldehyde-induced Modifications in Proteins, The Journal of Biological Chemistry, 2004,vol. 279, No. 8, pp. 6235-6243.

(56) References Cited

OTHER PUBLICATIONS

Mohamadzadeh, M et al., Dendritic Cell Targeting of Bacillus Anthracis Protective Antigen Expressed by Lactobacillus Acidophilus Protects Mice From Lethal Challenge, PNAS, 2009, vol. 106, No. 11, pp. 4331-4336.
Perez-Velez, Mariel et al., Induction of Neutralization Antibodies in Mice by Dengue-2 Envelope DNA Vaccines, National Institutes of Health, PR Health Sci, 2009, vol. 28, No. 3, pp. 239-250.
Ramanathan, Mathura et al., Development of Novel DNA SynCon Tetravalent Dengue Vaccine That Elicits Immune Responses Against Four Serotypes, Vaccine, 2009, vol. 27, No Number, pp. 6444-6453.
Schroeder, Ulrich et al. , Peptide Nanoparticles Serve as a Powerful Platform for the Immunogenic Display of Poorly Antigenic Actin Determinants, Science Direct, J. Mol. Biol., 2009, vol. 386, No Vol. Number, pp. 1368-1381.
Arce-Fonseca, Minerva et al., Specific Humoral and Cellular Immunity Induced by Trypanosoma cruzi DNA Immunization in a Canine Model, Veterinary Research, 2013, vol. 44, No. 15, pp. 2-9.
Steel, John et l., Influenza Virus Vaccine Based on the Conserved Hemagglutinin Stalk Domain, mBio, 2010, vol. 1, Issue 1, pp. 1-10.
Walker, Andreas et al., SplitCore: An Exceptionally Versatile Viral NanoParticles for Native Whole Protein Display Regardless of 3D Structure, Scientific Reporters, 2011, vol. 1, No. 5, pp. 1-8.
World Health Organization, WHO Manual on Animal Influenza Diagnosis and Surveillance, WHO Global Influenza Programme, CDS, CSR, NCS, 2002, vol. 5, No Number, pp. 1-99.
World Health Organization, Serological Diagnosis of Influenza by Microneutralization Assay, 2010, No Vol., pp. 1-25.
Coller, Barry S. et al, A New Murine Monoclonal Antibody Reports an Activation-Dependent Change in the Confirmation and/or Microenvironment of the Platelet Glycoprotein IIb/IIIa Complex, The American Society for Clinical Investigation, Inc., 1985, vol. 76, No Volume number, pp. 101-108.
Coller, BS et al., Inhibition of Dog Platelet Function by Vivo Infusion of F (ab')2 Fragments of a Monoclonal Antibody to Platelet Glycoprotien IIb/IIIa Receptor, Blood, 1985, vol. 66, No. 6, pp. 1456-1459.
Ellis, SG et al., Safety and Antiplatelet Effect of Murine Monoclonal Antibody 7E3 Fab Directed Against Platelet Glycoprotein IIb/IIIA in Patients Undergoing Elective Coronary Angioplasty, Coron Artery Dis., 1993, vol. 4, No. 2, pp. 167-175.
Abciximab (ReoPro)FDA Description, Jan. 4, 1997, No Volume number, pp. 1-17.
Califf, Robert et al., Use of a Monoclonal Antibody Directed Against the Platelet Glycoprotein IIB/IIIa Receptor in High-Risk Coronary Angioplasty, 1994, The New England Journal of Medicine, vol. 330, No. 14, pp. 1-6.
WHO Drug Information, International Nonproprietary Names for Pharmaceutical Substances (INN), 1993, vol. 7, No. 4, pp. 1-16.
Eli Lilly and Company, ReoPRo, Abciximab, Product Label, 2005, No volume number, pp. 1-4.
Kempeni, Joachim et al., Preliminary Results of Early Clinical Trials with the Fully Human Anti-TNFa Monoclonal Antibody D2E7, Ann Rheum Dis, 1999, vol. 58, Supp I, pp. 170-172.
Lindner, Heidrun et al., Peripheral Blood Mononuclear Cells Induce Programmed Cell Death in Human Endothelial Cells and May Prevent Repair: Role of Cytokines, 1997, vol. 89, No. 6, pp. 1931-1938.
Crowe, J.S. et al., Humanized Monoclonal Antibody CAMPATH-1H Myeloma Cell Expression of Genomic Constructs, Nucleotide Sequence of cDNA Constructs and Comparison of Effector Mechanisms of Myeloma and Chinese Hamster Ovary Cell-Derived Material, Clinical Exp. Immunol., 1992, vol. 87, No number, pp. 105-110.
Ferrara, James et al., Graft-versus Host Disease, Lancet, 2009, vol. 373, No. 9674, pp. 1550-1561.
Hale, G. et al., Removal of T Cells From Bone Marrow for Transplantation: a Monoclonal Antilyphocyte Antibody That Fixes Human Complement, Blood, 1983, vol. 62, No. 4, pp. 873-882.
Lutz, Riechmann et al., Reshaping Human Antibodies for Therapy, Nature,1988, vol. 332, No. 24 , pp. 323-327.
Novartis, Product Label, Simulect, Basiliximab, 1998, No Vol. pp. 1-7.
Baker, Kevin P. et al., Generation and Charaterization of LymphonStat-B, a Human Monoclonal Antibody That Antagonizes the Bioactivities of B Lymphocyte Stimulator, Arthritis & Rheumatism, 2003, vol. 48, No. 11, pp. 3253-3265.
ADIS R&D Profile, Belimumab, Drugs R D, 2010; vol. 10 , No. 1, pp. 55-65.
Avastin, Bevacizumab, Labeling Text, 2013, No Volume, pp. 1-27.
Chen, Helen et al., Expanding the Clinical Development of Bevacizumab, The Oncologist, 2004, vol. 9, Supp 1, pp. 27-35.
Herbst, Roy et al., Non-Small Cell Lung Cancer and Antiangiogenic Therapy: What Can Be Expected pf Bevacizumab?, The Oncologist, 2004, vol. 9 Supp. 1, pp. 19-26.
Presta, Leonard G. et al., Humanization of Anti-Vascular Endothelial Growth Factor Monoclonal Antibody for the Therapy of Solid Tumors and Other Disorders, Cancer Research, 1997, vol. 57, pp. 4593-4599.
Bowen, Michael et al., Functional Effects of CD30 on a Large Granular Lymphoma Cell Line,YT, The Journal of Immunology, 1993, vol. 151, No. 11, pp. 1-11.
ADCETRIS, brentuximab vedotin, Product Label, 2011,No Volume, pp. 1-15.
Francisco, Joseph et al., cAc10-vcMMAE, an Anti-CD30-monomethyl Auristatin E Conjugate with Potent and Selective Antitumor Activity, Blood, 2003,vol. 102, No. 4, pp. 1458-1465.
Wahl, Alan F. et al, The Anti-CD30 Monoclonal Antibody SGN-30 Promotes Growth Arrest and DNA Fragmentation in Vitro and Affects Antitumor Activity in Models of Hodgkins's Disease, Cancer Research, 2002, vol. 62, pp. 3737-3742.
Alten, Rieke et al., The Human Anti-IL-1β Monoclonal Antibody ACZ885 is Effective in Joint Inflammation Models in Mice and in a Proof-of-Concept Study in Patients with Rheumatoid Arthritis, Arthritis Research & Therapy, 2008, vol. 10, No. 3, pp. 1-9.
Canakinumab FDA Label, 2009, No Volume # pp. 1-11.
Church, L et al. , Canakinumab, a Fully Human mAB Against IL-1β for the Potential Treatment of Inflammatory Disorder, Current Opinion in Molecular Therapeutics, 2009, vol. 11, No. 1, pp. 81-89.
Lachmann, Helen et al., In Vivo Regulation of Interleukin 1β in Patients With Cryopyrin-Associated Periodic Syndromes, The Journal of Experimental Medicine, 2008, vol. 206, No. 5, pp. 1029-1036.
Lachmann, Helen et al., Use of Canakinumab in the Cryopyrin-Associated Periodic Syndrome, The New England Journal of Medicine, 2009, vol. 360, No. 23, pp. 2416-2425.
Rowe, William S. et al., Update on the Pathogenesis and Treatment of Systemic Idiopathic Arthritis, Curr. Opinion Pediat, 2011, vol. 23, No. 6, pp. 640-646.
Wells, Michael J. et al,. Pathophysiology and Clinical Implications of Pulmonary Arterial Enlargement in COPD, International Journal of COPD, 2013, vol. 8, No number, pp. 509-521.
ImClone Systems Incorporated and Bristol-Myers Squibb Company, ERBITUX, Cetuximab, 2004, No Vol number, pp. 1-18.
Goldstein, N et al., Biological Efficacy of a Chimeric Antibody to the Epidermal Growth Factor Receptor in a Human Tumor Xenograft Model, Clinical Cancer Research, 1995, vol. 1, No number, pp. 1311-1318.
Mendelsohn, J. et al, Epidermal Growth Factor Receptor Inhibition by a Monoclonal Antibody as Anticancer Therapy, 1997, vol. 3 No #, pp. 2703-2707.
Xiang, Bo et al., Colorectal Cancer Immunotherapy, Discovery Medicine, 2013, No Vol., pp. 1-8.
Chapman, Andrew et al., Therapeutic Antibody Fragments With Prolonged in Vivo Half-Lives, Nature America Inc., 1999, vol. 17, No Number, pp. 780-783.
Choy et al, Efficacy of a Novel PEGylated Humanized Anti-TNF Fragment (CDP870) in patients with Rheumatoid Arthritis: A phase II double-blinded, randomized, Dose-Escalating Trial, Rheumatology 2002; vol. 41, No number, pp. 1133-1137.
CIMZIA, Product Label, Reference ID: 3217327, UCB, Inc., 2008, No. Vol #, pp. 1-26.
Goel, N. et al, Certolizumab pegol, mABS, 2010, vol. 2, No. 2, pp. 137-147.

(56) References Cited

OTHER PUBLICATIONS

Mease, PJ et al., Effect of certolizumab pegol on signs and symptoms in patients with psoriatic arthritis: 24-week results of a Phase 3 double-blind randomized placebo-controlled study (RAPID-PsA), Ann Rheum Dis, 2014, vol. 73, No #, pp. 48-55.
Queen, C et al., A humanized antibody that binds to the interleukin 2 receptor, Proc. Nati. Acad. Sci. USA, 1989, vol. 86, pp. 10029-10033.
Jaffers, Gregory et al, Monoclonal Antibody Therapy, Transplantation, 1986, vol. 41, No. 5, pp. 572-578.
Ortho Multicenter Transplant Study Group, A Randomized Clinical Trial of OKT3 Monoclonal Antibody for Acute Rejection of Cadaveric Renal Transplants, The New England Journal of Medicine, 1985, vol. 313, No. 6, pp. 337-342.
Roche, Zenapax (daclizumabl) Sterile Concentrate for Injection, 2013, No Vol., pp. 1-11.
Bekker, Pirow et al., The Effect of a Single Dose of Osteoprotegerin in Postmenopausal Women, Journal of Bone and Mineral Research, 2001, vol. 16, No. 2, pp. 1-13.
Bekker, Prow et al., A single-Dose Placebo-Controlled Study of AMG 162, a Fully Human Monoclonal Antibody to RANKL, in Postmenopausal Women, Journal of Bone and Mineral Research, 2004, vol. 19, No. 7, pp. 1-8.
Body, Jean-Jacques et al., A Study of the Biological Receptor Activator of nuclear Factor-KappaB Ligand inhibitor, Denosumab, in patients with multiple myeloma or bone metastases from Breast Cancer, Clinical Cancer Research, 2006, vol. 12, No #, pp. 1221-1228.
Westenfeld, Ralf et al., Anti-RANKL therapy—implications for the bone-vascular-axis in CKD? Denosumab in post-menopausal women with low bone mineral density, Nephrol Dial Transplant, 2006, vol. 21, pp. 2075-2077.
Xgeva (denosumab) Product Label 2010-2013 pp. 1-16.
Hillmen, Peter et al., Effect of Eculizumab on Hemolysis and Transfusion Requirements in Patients with Paroxysmal Nocturnal Hemoglobinuria, The New England Journal of Medicine, 2004, vol. 350, No. 6, pp. 552-559.
Ministry of Health, Labour and Welfare, Report on the Deliberation Results, Soliris for Intravenous Infusion 300 mg, 2010, No Vol., pp. 1-105.
Golimumbab—Product Label—Janssen Biotech, Inc., 2013, No Volume number, pp. 1-19.
Garcia, Maria et al., Patient Consideration in the Management of Rheumatoid Arthritis: Role of Once-a-Month Golimumab Injection, Clinical Medical Insights: Therapeutics, Libertas Academica, 2011, vol. 3, No #, pp. 415-423.
Mazumdar, Sohini et al., Golimumab, mAbs, 2009, vol. 1, No. 5, pp. 422-431.
Shealy, David et al., Characterization of Golimumab, A Human Antibody Specific for Human Tumor Necrosis Factor α, mAbs, 2010, Volume No. 2, No. 4, pp. 428-439.
Hainsworth, John, Monoclonal Antibody Therapy in Lymphoid Malignancies, The Oncologist, 2000, vol. 5, No #, pp. 376-384.
FDA Label, Ibritumomab Tiuxetan, Zevalin, 2001, IDEC Pharmaceuticals Corporation, No Vol. pp. 1-38.
Wagner, Henry et al., Admiration Guidelines for Radioimmunotherapy of Non-Hodgkin's Lymphoma with 90Y-Labeled Anti-CD20 Monoclonal Antibody, 90Y Radioimmunotherapy Administration, The Journal of Nuclear Medicine, 2002, vol. 43, No. 2, pp. 267-272.
WHO Drug Information, International Nonproprietary Names for Pharmaceutical Substances (INN), Recommended INN, 2000, vol. 14, No. 1, pp. 39-76.
Fellner, Christopher et al., Ipilimumab (Yervoy) Prolongs Survival in Advanced Melanoma, Drug Forecast, 2012, vol. 37, No. 9, pp. 503-530.
Hooks, Michael et al., Muromonab CD-3: A Review of Its Pharmacology, Pharmacokinetics, and Clinical Use in Transplantation, Pharmacotherapy, 1991, vol. 11, No. 1, pp. 26-37.
FDA Guide, Tysabri, Elan Pharmaceuticals, Inc., Reference ID: 3308057, Biogen Idec, Inc. 2013, No Volume #, pp. 1-6.

Gordon, F.H., A Pilot Study of Treatment of Active Ulcerative Colitis With Natalizumab, a Humanized Monoclonal Antibody to Alpha-4 Integrin, Aliment Pharacol Ther, 2002, vol. 16, No #, pp. 699-705.
Guagnozzi, Danila etal, Natalizumab in the Treatment of Crohn's Disease, Biologics: Targets & Therapy, 208, vol. 2, No. 2, pp. 275-284.
Nicholas, J et al., New and Emerging Disease-Modifying Therapies for Relapsing-Remitting Multiple Sclerosis: What is New and What is to Come, Journal of Central Nervous System Disease, 2012, vol. 4, No#, pp. 81-103.
Minagar, Alireza et al., Current and Future Therapies for Multiple Sclerosis, Scientifica, 2012, vol. 2013, Artible ID 249101, pp. 1-11.
Cong, Shundong et al., Novel CD20 Monoclonal Antibodies for Lymphoma Therapy, Journal of Hematology & Oncology, 2012, vol. 5, No. 64, pp. 1-9.
FDA Label, Arzerra, Prescribing Info, 2009, GlaxoSmithKline, No. Vol, pp. 1-13.
Issa, Ghayas et al., Movel Agents in Waldenstrom Macroglobulinemia, Clin Investig, 2011, vol. 1, No. 6, pp. 815-824.
Jaglowski, Samantha et al., The clinical application of monoclonal antibodies in chronic lymphocytic leukemia, Blood, 2010, vol. 116, No #, pp. 3705-3714.
Rosman, Ziv et al., Biologic Therapy for Autoimmune Diseases: an update, BMC Medicine, 2013, vol. 11 No. 88 pp. 1-12.
Teeling, Jessica et al., Characterization of New Human CD20 Monoclonal Antibodies with Potent Cytolytic Activity Against Non-Hodgkin Lymphomas, Blood, 2004, vol. 104, No#, pp. 1793-1800.
Teeling, Jessica et al., The Biological Activity of Human CD20 Monoclonal Antibodies Is Linked to Unique Epitopes on CD20, The Journal of Immunology, 2006, vol. 177, No #, pp. 362-371.
Zhang, Bodi et al., Ofatumumab, mAbs, 2009, vol. 1, No. 4, pp. 326-331.
Vichyanond, Pakit et al., Omalizumab in allergic diseases, a recent review, Asian Pac J Allergy Immunol, 2011, vol. 29, No #, pp. 209-219.
Thomson, Neil et al, Circulatory, Respiratory and Pulmonary Medicine, Clinical Medicine Insights, 2012, vol. 6, No #, pp. 27-40.
FDA, Medication Guide Xolair, (omalizumab), 2013, No Vol. pp. 1-2.
Biopharma, Sample Synagis, MedImmune, Inc., 2013, No Vol. pp. 1-19.
FDA Label—SYNAGIS® (Palivizumab)—1999, MedImmune, Inc., No. Vol. pp. 1-7.
Huang, Kelly et al., Respiratory Syncytial Virus-Neutralizing Monoclonal Antibodies Motavizumab and Palivizumab Inhibit Fusion, Journal of Virology, Aug. 2010, vol. 84, No. 16, pp. 8132-8140.
FDA Label—Vectibix® (panitumumab), Amgen Inc., 2006-2008, No Vol., pp. 1-13.
Grunwalk, Viktor et al., Developing Inhibitors of the Epidermal Growth Factor Receptor for Cancer Treatment, Journal of the National Cancer Institute, 2003, vol. 95, No. 12, pp. 851-867.
Yang, Xiao-Dong et al., Eradication of Established Tumors by a Fully Human Monoclonal Antibody to the Epidermal Growth Factor Receptor without Concomitant chemotherapy, Cancer Research, 1999, vol. 59, No. #, pp. 1236-1243.
Yang, Xiao-Dong et al., Development of ABX-EGF, A Fully Human anti-EGF Receptor Monoclonal Antibody, For Cancer Therapy, Oncology Hematology, 2001, vol. 38, No. #, pp. 17-23.
FDA, Highlights of Prescribing Information Lucentis(ranibizumab injection), Genentech, Inc., 2006, No Vol., pp. 1-9.
Binder, Mascha et al., The Epitope Recognized by Rituximab, Blood, 2006, vol. 108, No. 6, pp. 1975-1978.
FDA Label, Actemra (tocilizumab), Risk Evaluation and Mitigation Strategy (REMS) 2013, Genentech, Inc., Reference ID: 3394610, No Vol. #, pp. 1-53.
FDA Label, Bexxar, Tositumomab and Iodine I 131 Tositumomab 2003, Corixa Corp. And GlaxoSmithKline, No Vol #, pp. 1-49.
Srinivasan, A. et al., Tositumomab and Iodine I 131 Tositumomab Bexaar, Pharmacology Vignette, 2011, vol. 32, No #, pp. 637-638.
FDA Guide, Herceptin (trastuzumab), Highlights of Prescribing Information, 2010, Genentech, Inc., pp. 1-33.

(56) References Cited

OTHER PUBLICATIONS

European Public Assessment Report (EPAR), Removab, European Medicines Agency, 2009, No Vol. # pp. 1-2.
Ruf, P. et al., Characterization of the New EpCAM-specific antibody HO-3: Implications for Trifunctional Antibody Immunotherapy of Cancer, British Journal of Cancer, 2007, vol. 97, No. 3, pp. 351.321.
Chelius, Dirk et al., Structural and functional characterization of the trifunctional antibody catumaxomab, mAbs, 2010, vol. 2 No. 3, pp. 309-319.
McLean, Leon et al., Vedolizumab for the treatment of ulcerative colitis and Crohn's disease, Immunotherapy, 2012, vol. 4, No. 9, pp. 883-898.
Reichert, Janice M. et al., Which Are the Antibodies to Watch in 2013, mAbs, 2013, vol. 5, No. 1, pp. 1-4.
Rob C. et al., IgG4 Breaking the Rules, Immunology, 2002, vol. 105, No #, pp. 9-19.
Alexandrakis, Michael et al., Relationship Between Circulating BAFF Serum Levels with Proliferating Markers in Patients with Multiple Myeloma, Biomed Research International, 2013, vol. 2013, Article ID. 389579, pp. 1-7.
Alfonso, Mauro et al., An Anti-Idiotype Vaccine Elicits a Specific Response to N-Glycolyl Sialic Acid Residues of Glycoconjugates in Melanoma Patients, The Journal of Immunology, 2002, vol. 168, No # , pp. 3523-2529.
Alonso, Ruby et al., Towards the Definition of a Chimpanzee and Human Conserved CD6 Domain 1 Epitope Recognized by T1 Monoclonal Antibody, Hybridoma, 2008, vol. 27, No. 4, pp. 291-301.
Alprolix, Highlights of Prescribing Information, Full Prescribing Information, Biogen Idec,2013, No Vol, pp. 1-19.
David McAuley, Pharm.D., Alzheimer's Disease—Therapeutic agents, 2012, No Vol. #, pp. 1-3.
Angevin, Eric et al., A Phase I/II, Multiple-Dose, Dose-Escalation Study of Siltuximab, an Anti-Interleukin-6 Monoclonal Antibody, in Patients with Advanced Solid Tumors, Clinical Cancer Research, 2014, vol. 20, No. 8, pp. 1-14.
Armstrong, Deborah, et al., Farletuzumab (MORAb-003) in platinum-sensitive ovarian cancer patients experiencing a first relapse, Community Oncology, 2010, vol. 7, No. 2, Supp 1., pp. 1-4.
Baeten, Dominique et al., Anti-interleukin-17A monoclonal antibody secukinumab in treatment of ankylosing spondylitis: a randomised, double-blind, placebo-controlled trial, The Lancet, 2013, vol. 382, No #, pp. 1705-1713.
Bai, D.L. et al., Huperzine A, A Potential Therapeutic Agent for Treatment of Alzheimer's Disease, Current Medicinal Chemistry, 2000, vol. 7, No. 3, pp. 355-374.
Ballatore, Carlo et al., Microtubule Stabilizing Agents as Potential Treatment for Alzheimer's Disease and Related Neurodegenerative Tauopathies, J. Med Chem., 2012, vol. 55, No. 21, pp. 8979-8996.
Barker, Edward, et al., Effect of a Chimeric Anti-Ganglioside GD2 Antibody on Cell-mediated Lysis of Human Neuroblastoma Cells, Cancer Researchm, 1991, vol. 51, No. #, pp. 144-149.
Bamias, Giorgos, et al., Leukocyte Traffic Blockage in Inflammatory Bowel Disease, Current Drug Targets, 2013, vol. 14, No. 12, pp. 1490-1500.
Blom, Dirk J. et al., A 52-Week Placebo-Controlled Trial of Evolocumab in Hyperlipidemia, The New England Journal of Medicine, 2014, No. Vol #, pp. 1-11.
Bococizumab, Statement on a Nonproprietary Name Adopted by the USAN Council, 2013, No Vol. pp. 1-2.
Bohrmann, Bernd et al., Gantenerumab: A Novel Human Anti-Aβ Antibody Demonstrates Sustained Cerebral Amyloid-β Binding and Elicits Cell-Mediated Removal of Human Amyloid-β, Journal of Alzheimer's Disease, 2012, vol. 28, No. #, pp. 49-69.
Borghaei, Hossein et al., Phase I Dose Escalation, Pharmacokinetic and Pharmacodynamic Study of Naptumomab Estafenatox Alone in Patients With Advanced Cancer and With Docetaxel in Patients With Advanced Non-Small-Cell Lung Cancer, Journal of Clinical Oncology, 2009, vol. 27, No. 25, pp. 4116-4123.
Bottero, Federica et al., GeneTransfection and Expression of the Ovarian Carcinoma Marker Folate Binding Protein on NIH/3T3 Cells Increases Cell Growth in Vitro and in Vivo, Cancer Research, 1993, vol. 53, No. #, pp. 5791-5796.
Bousquet, Jean MD et al, Eosinophilic Inflammation in Asthma, The New England Journal of Medicine, 1990, vol. 323, No. 15, pp. 1033-1039.
Burgess, Teresa et al., Biochemical Characterization of AMG 102: A Neutralizing, Fully Human Monoclonal Antibody to Human and Nonhuman Primate Hepatocyte Growth Factor, Molecular Cancer Therapeutics, 2010, vol. 9, No. 2, pp. 400-409.
Busse, William W. et al., Safety profile, pharmacokinetics, and biologic activity of MEDI-563, an anti-IL-5 receptor a antibody, in a phase I study of subjects with mild asthma, J Allergy Clin Immunol, 2010, vol. 125, No. 6, pp. 1237-1244.
Carnahan, Josette et al., Epratuzumab, a Humanized Monoclonal Antibody Targeting CD22 Characterization of in Vitro Properties, Clinical Cancer Research, 2009, vol. 9, No. #, pp. 1-8.
Castro, Mario et al., Reslizumab for Poorly Controlled, Eosinophilic Asthma, a Randomized, Placebo-controlled Study, American Journal of Respiratory and Critical Care Medicine, 2011, vol. 184, No#, pp. 1125-1132.
Cavelti-Weder, Claudia et al., Effects of Gevokizumab on Glycemia and Inflammatory Markers in Type 2 Diabetes, Diabetes Care, 2012, vol. 35, No number, pp. 1654-1662.
Chou, Hsun-Hua et al., A mutation in human CMP-sialic acid hydroxylase occurred after the Homo-Pan divergence, Proc. Natl. Acad. Sci. USA,1998, vol. 95, No #, pp. 11751-11756.
Grundy, Scott et al., Promise of Low-Density Lipoprotein-Lowering Therapy for Primary and Secondary Prevention, Circulation Journal of the American Heart Association, 2008, vol. 117, No #, pp. 569-573.
Raal, Frederick et al., Low-Density Lipoprotein Cholesterol-Lowering Effects of AMG 145, a Monoclonal Antibody to Proprotein Convertase Subtilisin/Kexin Type 9 Serine Protease in Patients With Heterozygous Familial Hypercholesterolemia: The Reduction of LDL-C With PCSK9 Inhibition in Heterozygous Familial Hypercholesterolemia Disorder (RUTHERFORD) Randomized Trial, Circulation, 2012, vol. 126, pp. 2408-2417.
Roche Pharma AG, A Study to Evaluate Two Doses of Ocrelizumab in Patients With Active Systemic Lupus Erythematosus (BEGIN), ClinicalTrials.gov, Apr. 1, 2014, No Vol #, http://clinicaltrials.gov/ct2/show/NCT00539838, pp. 1-4.
Genentech, A Study of the Efficacy and Safety of Ocrelizumab in Patients With Relapsing-Remitting Multiple Sclerosis, ClinicalTrials.gov, Apr. 1, 2014, http://clinicaltrials.gov/ct2/show/NCT00676715, pp. 1-3.
Morphotek, Efficacy and Safety of MORAb-003 in Subjects With Platinum-sensitive Ovarian Cancer in First Relapse, ClinicalTrials.gov, Apr. 2, 2014, http://clinicaltrials.gov/ct2/show/NCT00849667?term=Farletuzumab&rank=4&submit_fld_opt, pp. 1-3.
Roche Pharma AG, A Study to Investigate the Efficacy and Safety of Bendomustine Compared With Bendamustine +RO5072759 (GA101) in Patients With Rituximab-Refactory, Indolent Non-Hodgkin's Lymphoma (GADOLIN) ClinicalTrials.gov, Apr. 2, 2014, http://clinicaltrials.gov/ct2/show/NCT01059630?term=Obinutuzumab&rank=20&submit_fld_opt, pp. 1-3.
Eli Lilly and Company, A Study of Ramucirumab (IMC-1121B) Drug Product (DP) and Best Supportive Care (BSC) Versus Placebo and BSC as 2nd-Line Treatment in Patients With Hepatocellular Carcinoma After 1st-Line Therapy With Sorafenib (REACH), ClinicalTrials.gov , Apr. 2, 2014, http://clinicaltrials.gov/ct2/show/NCT01140347?term=ramucirumab&rank=12&submit_fld_opt, pp. 1-4.
Eli Lilly and Company, A Study of Chemotherapy and Ramucirumab vs. Chemotherapy Alone in Second Line Non-small Cell Lung Cancer Participants Who Received Prior First Line Platinum Based Chemotherapy, ClinicalTrials.gov, Apr. 2, 2014, http://clinicaltrials.gov/ct2/show/NCT01168973=ramucirumab&rank=2&submit_fld_opt, pp. 1-4.
Eli Lilly and Company, A Study of Paclitaxel With or Without Ramucirumab in Metastatic Gastric Adenocarcinoma, ClinicalTrials.

(56) References Cited

OTHER PUBLICATIONS gov, Apr. 2, 2014, http://clinicaltrials.gov/ct2/show/NCT01170663?term=ramucirmab&rank=5&submit_fld_opt, pp. 1-4.
Eli Lilly and Company, A Study in Second Line Metstatic Colorectal Cancer, ClinicalTrials.gov, Apr. 2, 2014, http://clinicaltrials.gov/ct2/show/NCT01183780?term=ramucirumab&rank=20&submit_fld_opt, pp. 1-4.
Hoffmann-La Roche, A Study of Obinutuzumab (RO5072759) in Combination With CHOP Chemotherapy Versus Mab Thera/Rituxan (Rituximab) With CHOP in Patients With CD20-Positive Diffuse Large B-Cell Lymphoma (GOYA), ClinicalTrials.gov, Apr. 2, 2014, http://clinicaltrials.gov/ct2/show/NCT01287741?term=Obinutzumab&rank=13&submit_fld_opt, pp. 1-3.
Hoffman-La Roche, A Study of Obinutuzumab (RO5072759) Plus Chemotherapy in Comparison With MabThera/Rituxan (Rituximab) Plus Chemotherapy Followed by GA101 or MabTher/Rituxan Maintenance in Patients With Untreated Advanced Indolent Non-Hodgkin's Lymphoma (GALLIUM), ClinicalTrials.gov, Apr. 2, 2014, http://clinicaltrials.gov/ct2/shown/NCT01332968, pp. 1-3.
Avid Radiopharmaceuticals, Dominantly Inherited Alzheimer Network Trial: An Opportonity to Prevent Dementia. A Study of Potential Disease Modifying Treatments in Individuals at Risk for or With a Type of Early Onset Alzheimer's Disease Caused by a Genetic Mutation. (DIAN-TU), ClinicalTrials.gov, Apr. 2, 2014, http://clinicaltrials.gov/ct2/show/NCT01760005, pp. 1-5.
Eli Lilly and Company, Progress of Mild Alheimer's Disease in Participants on Solanezumab Versus Placebo (EXPEDITION 3), ClinicalTrials.gov, Apr. 2, 2014, http://clinicaltrials.gov/ct2/show/NCT01900665, pp. 1-3.
Eli Lilly and Company, Clinical Trial of Solanezumab for Older Individuals Who May be at Risk for Memory Loss (A4). ClinicalTrials.gov, Apr. 2, 2014, http://clinicaltrials.gov/ct2/show/NCT02008357, pp. 1-3.
Cohen, Idan et al., Differential release of chromatin-bound IL-1a Discriminates Between Necrotic and Apoptotic Cell Death by the Ability to Induce Sterile Inflammation, PNAS, 2010, vol. 107, No. 6, pp. 2574-2579.
Conde, Francisco et al., The Aspergillus toxin restrictocin is a suitable cytotoxic agent for generation of immunoconjugates with monoclonal antibodies directed against human carcinoma cells, Eur. J. Biochern, 1989, vol. 178, No #, pp. 795-802.
Coney, Leslie et al., Cloning of Tumor-associated Antigen: MOv18 and MOv19 Antibodies Recognize a Folate-binding Protein, Cancer Research, 1991, vol. 51, No #, pp. 6125-6132.
Corren, Jonathan et al., Lebrikizumab Treatment in Adults with Asthma, The New England Journal of Medicine, 2011, vol. 365, No. 12, pp. 1088-1098.
Daridon, Capucine et al., Epratuzumab Affects B Cells Trafficking in Systemic Lupus Erythematosus, Ann Rheum Dis, 2011, vol. 70, No #, pp. 1-2.
Devine, Peter L. et al., The Breast Tumor-associated Epitope Defined by Monoclonal Antibody 3E1.2 Is an O-linked Mucin Carbohydrate Containing N-Glycolylneuraminic Acid, Cancer Research, 1991, vol. 51, No #, pp. 5826-5836.
DiJoseph, John F. et al., Antibody-targeted chemotherapy with CMC-544: a CD22-targeted immunoconjugate of calicheamicin for the treatment of B-lymphoid malignancies, Blood, 2004, vol. 103, No #, pp. 1807-1814.
Dodart, Jean-Cosme et al., Immunization reverses memory deficits without reducing brain a burden in Alzheimer's disease model, Nature Neuroscience, 2002, vol. 5, No. 5, pp. 452-457.
Doody, Rachelle S. et al., Phase 3 Trials of Solanezumab for Mild-to-Moderate Alzheimer's Disease, NEJM Journal Watch, Apr. 2, 2014, No Vol. No #, http://www.nejm.org/doi/full/10.1056/NEJMoa1312889, pp. 1-2.
National Cancer Institute, Drugs Approved for Ovarian Cancer, Aug. 16, 2013, No Vol.,pp. 1-2.

Dumont, Jennifer A. et al., Prolonged activity of a recombinant factor VIII-Fc fusion protein in hemophilia A mice and dogs, Blood, 2012, vol. 119, No. #, pp. 3024-3030.
Ebel, Wolfgang et al, Preclinical Evaluation of MORAb-003, a Humanized Monoclonal Antibody Antagonizing Folate Receptor-alpha, Cancer Immunity, 2007, vol. 7 No. #, pp. 1-8.
Eisen, Tim et al., Naptumomab Estafenatox: Targeted Immunotherapy with a Novel Immunotoxin, Curr Oncol Rep, 2014, vol. 16, N. 370 pp. 2-6.
Erlandsson, Eva et al., Identification of the Antigenic Epitopes in Staphylococcal Enterotocins A and E and Design of a Superantigen for Human Cancer Therapy, J. Mol. Biol., 2003, vol. 333, No #, pp. 893-905.
Mayo Clinic, Factor Ix Complex (Intravenous Route, Injection Route) Description and Brand Names—Drugs and Supplements, http://www.mayoclinic.org/drugs-supplements/factor-ix-complex-intravenous-route-injection-route/description/drg-20063804, Apr. 1, 2014, No Vol., pp. 1-3.
Ferrara, Claudia et al., Unique carbohydrate—carbohydrate interactions are required for high affinity binding between FcγRIII and antibodies lacking core fucose, PNAS, 2011, No Vo. #, pp. 1-6.
Figini, M. et al., Reversion of transformed phenotype in ovarian cancer cells by intracellular expression of anti folate receptor antibodies, Gene Therapy, 2003 vol. 10, No #, pp. 1018-1025.
Vasquez, Ana et al., Racotumomab: an anti-idiotype vaccine related to N-Glycolyl-containing gangliosides-preclinical and clinical date, Frontiers in Oncology, 2012, vol. 2, Article 150, pp. 1-6.
Forsberg, G. et al., Therapy of Human Non-Small-Cell Lung Carcinoma Using Antibody Targeting of a Modified Superantigen, British Journal of Cancer, 2001, vol. 85, No. 1, pp. 129-136.
Forsberg, G et al., Naptumomab Estafentoz, an Engineered Antibody-superantigen Fusion Protien with Low Toxicity and Reduced Antigenicity, J Immunother, 2010, vol. 33, No. 5, pp. 492-499.
Feagan, Brian et al., Vedolizumab as Induction and Maintenance Therapy for Ulcerative Colitis, The New England Journal of Medicine, 2013, vol. 369, No. 8, pp. 699-710.
Furie, Richard et al., A Phase III, Randomized, Placebo-Controlled Study of Belimumab, a Monoclonal Antibody That Inhibits B Lymphocyte Stimulator, in Patients With Systemic Lupus Erythematosus, Arthritis & Rheumatism, 2011, vol. 63, No. 12, pp. 3918.3930.
Garcia, Gilles et al., Anti-interleukin-5 Therapy in Serve Asthma, Rare Diseases and Orphan Drugs, 2013, vol. 22, No. #, pp. 251-257.
Garin-Chesa, Pilar et al., Trophoblast and Ovarian Cancer Antigen LK26, American Journal of Pathology, 1993, vol. 142, No. 2, pp. 557-567.
Genovese, Mark C et al., Efficacy and safety of secukinumab in patients with rheumatoid arthritis: a phase II, dose-finding, double-blind, randomised, placebo controlled study, Ann Rheum Dis, 2013; vol. 72, No #, pp. 863-869.
Genovese, Mark C et al., A phase 2 dose-ranging study of subcutaneous tabalumab for the treatment of patients with active rheumatoid arthritis and an inadequate response to methotrexate, Ann Rheum Dis 2013; vol. 72, No#, pp. 1453-1460.
Genovese, Mark C et al., Ocrelizumab, a Humanized Anti-CD20 Monoclonal Antibody, in the Treatment of Patients With Rheumatoid Arthritis, Arthritis & Rheumatism, 2008, vol. 58, No. 9, pp. 2652-2661.
Gevaert, Philippe, et al., Mepolizumab, a humanized anti-IL-5 mAb, as a treatment option for severe nasal polyposis, Rhinitis, sinusitis, and upper airway disease, J Allergy Clin Immunol, 2011, vol. 128, No. 5, pp. 989-995.
Ghazi, Aasia et al., Benralizumab—a Humanized mAb to IL-5Rα with enhanced antibody-dependent cell-mediated cytotoxicity—a novel approach for the treatment of asthma, Expert Opin Biol Ther. 2012, vol. 12, No. 1, pp. 113-118.
Gillies, Stephen et al., Antibody-targeted interleukin 2 stimulates T-cell killing of Autologous Tumor Cells, Proc. Natl. Acad. Sci., 1992, vol. 89, No #, pp. 1428-1432.
Grant, Ryan W. et al., Mechanisms of disease: inflammasome activation and the development of type 2 diabetes, Frontiers in Immunology, 2013, vol. 4, Article 50, pp. 1-10.

(56) References Cited

OTHER PUBLICATIONS

Greenfeder, Scott et al., Th2 cytokines and asthma the role of interleukin-5 in allergic eosinophilic disease, Respiratory Research, 2001, vol. 2, No. 2, pp. 71-79.
Grünig, Gabriele et al., Interleukin 13 and the evolution of asthma therapy, Am J Clin Exp Immunol, 2012;vol. 1, No. 1, pp. 20-27.
Hamid, Omid et al., Safety and Tumor Responses with Lambrolizumab (Anti-PD-1) in Melanoma, The New England Journal of Medicine, 2013, vol. 369, No. 2, pp. 134-144.
Hank, Jacquelyn, et al., Immunogenicity of the Hu14.18-IL2 Immunocytokine Molecule in Adults With Melanoma and Children With Neuroblastoma, Clinical Cancer Research, 2009, vol. 15, No. 18, pp. 5923-5930.
Hart, Timothy K. et al., Preclinical efficacy and safety of mepolizumab (SB-240563), a humanized monoclonal antibody to IL-5, in cynomolgus monkeys, J Allergy Clin Immunol, 2001, vol. 108, No. 2, pp. 250-257.
Hedlund, Gunnar et al., The Tumor Targeted Superantigen ABR-217620 Selectively Engages TRBV7-9 and Exploits TCR-pMHC Affinity Mimicry in Mediating T Cell Cytotoxicity, PLOS One, 2013, vol. 8, Issue 10, pp. 1-17.
Hernández, Ana Maria et al., Anti-NeuGcGM3 Antibodies, Actively Elicited by Idiotypic Vaccination in Nonsmall Cell Lung Cancer Patients, Induce Tumor Cell Death by an Oncosis-Like Mechanism, The Journal of Immunology, 2011, vol. 186, No #, pp. 3735-3744.
Humbert, Marc et al., Relationship between IL-4 and IL-5 mRNA Expression and Disease Severity in Atopic Asthma, Am J Respir Crit Care Med, 1997, vol. 156, No #, pp. 704-708.
Hole, N. et al., A 72 kD trophoblast glycoprotein defined by a monoclonal antibody, Br. J. Cancer 1988,vol. 57, No. #, pp. 239-246.
Huizinga, Tom W J et al., Sarilumab, a fully human monoclonal antibody against IL-6Rα in patients with rheumatoid arthritis and an inadequate response to methotrexate: efficacy and safety results from the randomized SARIL-RA-MOBILITY Part A trial, Ann Rheum Dis, 2013; No Vol. pp. 1-9.
Imbimbo, Bruno P et al., Solanezumab for the treatment of mild-to-moderate Alzheimer's disease, Expert Rev. Clin. Immunol., 2012, vol. 8, No. 2, pp. 135-149.
Ito, Asahi et al., Defucosylated anti-CCR4 monoclonal antibody exercises potent ADCC-mediated antitumor eVect in the novel tumor-bearing humanized NOD/Shi-scid, IL-2R__null mouse model, Cancer Immunol Immunother, 2009, vol. 58, No #, pp. 1195-1206.
Winkler, David G. et al., Noggin and Sclerostin Bone Morphogenetic Protein Antagonists Form a Mutually Inhibitory Complex, J. Biol. Chem., 2004, vol. 279, pp. 36293-36298.
Janssens, Ann et al., Rixuximab for Chronic Lymphocytic Leukemia in Treatment-Naïve and Treatment-Experienced, OneLive, Bringing Oncology Together, Apr. 2, 2014, No Vol. , pp. 1-7.
Jia, Guiquan et al., Periostin is a systemic biomarker of eosinophilic airway inflammation in asthmatic patients, J Allergy Clin Immunol, 2012, vol. 130, No. 3, pp. 647-654.
Jin, Wei et al., IL-17 cytokines in immunity and inflammation, Emerging Microbes and Infections, 2013, vol. 2, No. #, pp. 1-5.
Kappos, Ludwig, et al., Ocrelizumab in relapsing-remitting multiple sclerosis: a phase 2, randomised, placebo-controlled, multicentre trial, The Lancet, 2011, vol. 378, Issue 9805, pp. 1779-1787.
Kaur, Sukhwinder et al., Mucins in pancreatic cancer and its microenvironment, Nature Reviews, 2013, No Vol., pp. 1-14.
Kausar, Fariha et al., Ocrelizumab: A Step Forward in the Evolution of B-Cell Therapy, Expert Opinion Biol. Ther., 2009, vol. 9, No. 7, pp. 889-895.
Kim, Busun et al., The Interleukin-1a precursor is Biologically Active and Is Likely a Key Alarmin in the IL-1 Family of Cytokines, Frontiers in Immunology, 2013, vol. 4, Article 391, pp. 1-9.
Koenigsknecht-Talboo, Jessica et al., Rapid Microglial Response Around Amyloid Pathology after Systemic Anti-A__Antibody Administration in PDAPP Mice, The Journal of Neuroscience, 2008, vol. 28, No. 52, pp. 14156-1414.
Koren, Michel J. et al., Efficacy and Safety of Longer-Term Administration of Evolocumab (AMG 145) in Patients With Hypercholesterolemia: 52-Week Results From the Open-Label Study of Long-Term Evaluation Against LDL-C (OSLER) Randomized Trial, Circulation, 2013, No Vol., pp. 1-20.
Kreitman, Robert J. et al., Antibody Fusion Proteins: Anti-CD22 Recombinant Immunotoxin Moxetumomab Pasudotox, Clinical Cancer Research, 2011, vol. 17, No #, pp. 6398-6405.
Kreitman, Robert J. et al., Phase I Trial of Anti-CD22 Recombinant Immunotoxin Moxetumomab Pasudotox (CAT-8015 or HA22) in Patients With Hairy Cell Leukemia, Journal of Clinical Oncology, 2012, vol. 30, No. 15, pp. 1822-1826.
Krueger, Gerald G. et al., A Human Interleukin-12/23 Monoclonal Antibody for the Treatment of Psoriasis, The New England Journal of Medicine, 2007,vol. 356, No. 6, pp. 580-592.
Kuenen, Bart et al., A Phase I Pharmacologic Study of Necitumumab (IMC-11F8), a Fully Human IgG 1 Monoclonal Antibody Directed Against EGFR in Patients with Advanced Solid Malignancies, Clinical Cancer Research, 2010, vol. 16, No #, pp. 1915-1923.
Kuijpers, Taco W. et al., CD20 deficiency in humans results in impaired T cell—independent antibody responses, The Journal of Clinical Investigation, 2010, vol. 120, No. 1, pp. 214-222.
Kurzrock, Razelle et al., A Phase I, Open-Label Study of Siltuximab, an Anti-IL-6 Monoclonal Antibody, in Patients with B-cell Non-Hodgkin Lymphoma, Multiple Myeloma, or Castleman Disease,Clinical Cancer Research, 2013, vol. 19, NO #, pp. 3659-3670.
Lach-Trifilieff, Estelle et al., An Antibody Blocking Activin Type II Hypertrophy and Protects from Atrophy Receptors Induces Strong Skeletal Muscle, Molecular and Cellular Biology, 2004, vol. 34, No. 4, pp. 606-618.
Legleiter, Justin et al., Effect of Different Anti-Aβ Antibodies on Aβ Fibrillogenesis as AAssessed by Atomic Force Microscopy, J. Mol. Biol, 2004, vol. 335, No #, pp. 997-1006.
Leonard, JP et al., Preclinical and clinical evaluation of epratuzumab (anti-CD22 IgG) in B-cell malignancies, Oncogene, 2007, vol. 26 No #, pp. 3704-3713.
Leonardi, Craig et al., Anti-Interleukin-17 Monoclonal Antibody Ixekizumab in Chronic Plaque Psoriasis, The New England Journal of Medicine, 2012, vol. 366, No. 13, pp. 1190-1199.
Lindén, Ola, et al., Dose-Fractionated Radioimmunotherapy in Non-Hodgkin's Lymphoma Using DOTA-Conjugated, 90Y-Radiolabeled, Humanized Anti-CD22 Monoclonal Antibody, Epratuzumab, Clinical Cancer Research, 2005, vol. 11, No #, pp. 5215-5222.
Braun, Stephen et al., Preclinical Studies of Lymphocyte Gene Therapy for Mild Hunter Syndrome (Mucopolysaccharidosis Type II), Human Gene Therapy, 1996, vol. 7, pp. 283-290.
Liu, Alvin et al, Production of a Mouse-Human Chimeric Monoclonal Antibody to CD20 With Potent Fc-Dependent Biological Activity, The Journal of Immunology, 1987,vol. 139, No. 10, pp. 3521-3526.
Lonial, Sagar, et al., Elotuzumab in Combination With Lenalidomide and Low-Dose Dexamethasone in Relapsed or Refractory Multiple Myeloma, Journal of Clinical Oncology, 2012, vol. 30, No. 16, pp. 1953-1959.
Lu, Dan et al., Tailoring in Vitro Selection for a Picomolar Affinity Human Antibody Directed against Vascular Endothelial Growth Factor Receptor 2 for Enhanced Neutralizing Activity, The Journal of Biological Chemistry, 2003, vol. 278, No. 44, pp. 43496-43507.
Lubberts, Erik et al., Treatment With a Neutralizing Anti-Murine Interleukin-17 Antibody After the Onset of Collagen-Induced Arthritis Reduces Joint Inflammation, Cartilage Destruction, and Cone Erosion, Arthritis & Rheumatism, 2004, vol. 50, No. 2, pp. 650-659.
MacLean, Catherine et al., Ststematic Review: Comparative Effectiveness of Treatments to Prevent Fractures in Men and Women with Low Bone Density or Osteoporosis, Annals of Internal Medicine, 2008, vol. 148, No. 3, pp. 197-217.
Marquina, Gilda et al., Gangliosides Expressed in Human Breast Cancer, Cancer Res, 1996; vol. 56, No #, pp. 5165-5171.
Matsue, Hiroyuki et al., Folate receptor allows cells to grow in low concentrations of 5-methyltetrahydrofolate, Proc. Natl. Acad. Sci. USA, Cell Biology, 1992, vol. 89, No #, pp. 6006-6009.
McInnes, Iain B et al., Efficacy and safety of secukinumab, a fully human anti-interleukin-17A monoclonal antibody, in patients with

(56) References Cited

OTHER PUBLICATIONS moderate-to-severe psoriatic arthritis: a 24-week, randomised, double-blind, placebo-controlled, phase II proof-of-concept trial, Ann Rheum Dis, 2014; vol. 73, No. #, pp. 349-356.

McKenney, James M. et al., Safety and Efficacy of a Monoclonal Antibody to Proprotein Convertase Subtilisin/GKexin Type 9 Serine Protease, SAR236553/REGN727, in Patients With Primary Hypercholesterolemia Receiving Ongoing Stable Atorvastatin Therapy, Journal of the American College of Cardiology, 2012, vol. 59, No. 25, pp. 2344-2353.

Di Meglio, Paola et al., The role of IL-23 in the immunopathogenesis of psoriasis, Biology Reports, 2010, vol. 2, No. 40, pp. 1-5.

Merelli, Barbara et al., Targeting the PD1/PD-L1 axis in melanoma: Biological rationale, clinical challenges and opportunities, Critical Reviews in Oncology/Hematology, 2014, vol. 89, No #, pp. 140-165.

Moreaux, Jérôme et al., BAFF and APRIL protect myeloma cells from apoptosis induced by interleukin 6 deprivation and dexamethasone, Blood, 2004, vol. 103, No #, pp. 3148-3157.

Morgan, D., Immunotherapy for Alzheimer's disease, Journal of Internal Medicine, 2011, vol. 269, No #, pp. 54-63.

Mujoo, Kalpana et al., Disialoganglioside GD2 on Human Neuroblastoma Cells: Target Antigen for Monoclonal Antibody-mediated Cytolysis and Suppression of Tumor Growth, Cancer Research, 1987, vol. 47, No #, 1098-1104.

Mujoo, Kalpana et al., Functional Properties and Effect on Growth Suppression of Human Neuroblastoma Tumors by Isotype Switch Variants of Monoclonal Antiganglioside GD2 Antibody 14.18, Cancer Research, 1989, vol. 49, No #, pp. 2857-2861.

Mössner, Ekkehard, Increasing the efficacy of CD20 antibody therapy through the and immune effector cell-mediated B-cell cytotoxicity engineering of a new type II anti-CD20 antibody with enhanced direct, Blood, 2010, vol. 115, No #, pp. 4393-4402.

Nair, P. et al., CD6 synergistic co-stimulation promoting proinflammatory response is modulated without interfering with the activated leucocyte cell adhesion molecule interaction, Clinical& Experimental Immunology, 2010, vol. 162, No #, pp. 116.130. Experimental Immunology, i_4235.

Neal, Zane C. et al., Enhanced Activity of Hu14.18-IL2 Immunocytokine against Murine NXS2 Neuroblastoma when Combined with Interleukin 2 Therapy, Clinical Cancer Research, 2004, vol. 10, pp. 4839-4847.

Neer, Robert M. et al., Effect of Parathyroid Hormone (1-34) on Fractures and Bone Mineral Density in Postmenopausal Women With Osteoporosis, The New England Journal of Medicine, 2001, vol. 344, No. 19, pp. 1434-1441.

Negrier, Claude et al., Enhanced pharmacokinetic properties of a glycoPEGylated recombinant factor IX: a first human dose trial in patients with hemophilia B, Blood, 2011, vol. 118, No #, pp. 2695-2701.

Neninger, Elia et al., Active Immunotherapy with 1E10 Anti-Idiotype Vaccine in Patients with Small Cell Lung Cancer, Cancer Biology & Therapy, 2007, vol. 6, No. 2., pp. 1-6.

Novakovic, Dijana et al., Profile of Gantenerumab and Its Potential in the Treatment of Alzheimer's Disease, Drug Design, Development and Therapy, 2013, vol. 7, No #, pp. 1359-1364.

Wright, Timothy M.D., Transforming Molecules into Breakthrough Therapies, Novartis, Investor Day, London,2013, No Vol. pp. 1-16.

Oldhoff et al., Anti-IL-5 recombinant Humanized Monoclonal Antibody (Mepolizumab) for the treatment of atopic dermatitis, Allergy, 2005, vol. 60, No # pp. 693-696.

Ostrowitzki, Susanne et al., Mechanism of Amyloid Removal in Patients with Alzheimer Disease Treated with Gantenerumab, Arch Neurol., 2012, vol. 69, No. 2, pp. 1-10.

Ottone, F. et al., Relationship Between folate-binding Protein Expression and Cisplatin Sensitivity in Ovarian Carcinoma Cell Lines, British Journal of Cancer, 1997, vol. 76, No. 1, pp. 77-82.

Papp, KA et al., Anti-IL-17 Receptor Antibody AMG 827 Leads to Rapid Clinical Response in Subjects with Moderate to Severe Psoriasis: Results from a Phase I, Randomized, Placebo-Controlled Trial, Journal of Investigative Dermatology, 2012, vol. 132, No #, pp. 2466-2469.

Papp, Kim, et al., Brodalumab, an Anti-Interleukin- 17-Receptor Antibody for Psoriasis, The New England Journal of Medicine, 2012, vol. 366, No. 13, pp. 1181-1189.

Papp, KA et al, Efficacy and safety of secukinumab in the treatment of moderate-to-severe plaque psoriasis: a randomized, double-blind, placebo-controlled phase II dose-ranging study, 2013,British Journal of Dermatology, vol. 168, No #, pp. 412-421.

Pasadhika, Sirichai et al., Update on the use of systemic biologic agents in the treatment of oninfectious uveitis, Biologics: Targets and Therapy, 2014, vol. 8 No #, pp. 67-81.

Pavord, Ian D et al., Mepolizumab for severe eosinophilic asthma (DREAM): a multicentre, double-blind, placebo-controlled trial, The Lancet, 2012, vol. 380, No Vol #, 2012, pp. 651-659.

Sanofi, Fact Sheet, PCSK9 and Alirocumab Backgrounder, Regeneron, 2013, No Vol. pp. 1-3.

Peters, R.T. et al., Biochemical and functional characterization of a recombinant monomeric factor VII-Fc fusion protein, Journal of Thrombosis and Haemostasis, 2012, vol. 11, pp. 132-141.

Powell, Jerry S. et al., Safety and prolonged activity of recombinant factor VIII Fc fusion protein in hemophilia A patients, Blood, 2012, vol. 119, No #, pp. 3031-3037.

Prewett, Marie et al., Kinase 1) Monoclonal Antibody Inhibits Tumor Angiogenesis Antivascular Endothelial Growth Factor Receptor (Fetal Liver Kinase 1) Monoclonal Antibody Inhibits Tumor Angiogenesis and Growth of Several Mouse and Human Tumors, Cancer Res, 1999; vol. 59, No #, pp. 5209-5218.

Raal, Frederick et al., Elevated PCSK9 Levels in Untreated Patients With Heterozygous or Homozygous Familial Hypercholesterolemia and the Response to High-Dose Statin Therapy, Journal of the American Heart Association, 2013, No Vol., pp. 1-8.

Rich, PP. et al., Secukinumab induction and maintenance therapy in moderate-to-severe plaque psoriasis: a randomized, double-blind, placebo-controlled, phase II regimen-finding study, British Journal of Dermatology, Therapeutics, 2013, vol. 168, No #, pp. 402-411.

Rossi, Edmund et al., Trogocytosis of Multiple B-cell Surface Markers by CD22 Targeting With Epratuzumab, Blood, 2013, vol. 122, No #, pp. 3020-3029.

Rossjohn, Jamie et al., Structure of the activation domain of the GM-CSF/IL-3/1L-5 receptor common β -chain bound to an antagonist, Blood, 2000, vol. 95, No #, pp. 2491-2498.

Roth, Eli M. et al., Atorvastatin with or without an Antibody to PCSK9 in Primary Hypercholesterolemia, The New England Journal of Medicine, 2012, vol. 367, vol. 20, pp. 1891-1900.

Roufosse, Florence E., et al., Long-term safety of mepolizumab for the treatment of hypereosinophilic syndromes, J Allergy Clin Immunol. 2013; vol. 131, No. 2, pp. 461-467.

Salles, Gilles et al., Phase 1 study results of the type II glycoengineered humanized lymphoma patients anti-CD20 monoclonal antibody obinutuzumab (GA101) in B-cell, Blood, 2012, vol. 119, No #., pp. 5126-5132.

Sandborn, William J. et al., Vedolizumab as Induction and Maintenance Therapy for Crohn's Disease, The New England Journal of Medicine, 2013, vol. 369, No. 8, pp. 711-721.

Schuelke, Markus M.D. et al., Myostatin Mutation Associated With Gross Muscle Hypertrophy in a Child, The New England Journal of Medicine, 2004, vol. 350, No. 26, pp. 2862-2688.

Shusterman, Suzanne et al., Antitumor Activity of Hu14.18-IL2 in Patients With Relapsed/Refractory Neuroblastoma: A Children's Oncology Group (COG) Phase II Study, Journal of Clinical Oncology, 2010, vol. 28, No. 33, pp. 4969-4975.

Hueber, Wolfgang et al., Effects of AIN457, a Fully Human Antibody to Interleukin-17A, on Psoriasis, Rheumatoid Arthritis, and Uveitis, Science Translational Medicine, 2010, vol. 2, Issue 52, pp. 1-9.

Scursoni, Alejandra M. Et al., Detection of N-Glycolyl GM3 Ganglioside in Neuroectodermal Tumors by Immunohistochemistry: An Attractive Vaccine Target for Aggressive Pediatric Cancer, Clinical and Developmental Immunology, 2011, vol. 2011, Article ID., 245181, pp. 1-6.

(56) References Cited

OTHER PUBLICATIONS

Semënov, Mikhail et al., SOST Is a Ligand for LRP5/LRP6 and a Wnt Signaling Inhibitor, The Journal of Biological Chemistry, 2005, vol. 280, No. 29., pp. 26770-26775.
Shapiro, Amy D. et al., Recombinant factor IX-Fc fusion protein (rFIXFc) demonstrates safety and prolonged activity in a phase 1/2a study in hemophilia B patients, Blood, 2012, vol. 119, No #, pp. 666-672.
Sieger, N. et al., CD22 Ligation Inhibits Downstream B Cell Receptor Signaling and Ca2_Flux Upon Activation, Arthritis & Rheumatism, 2013, vol. 65, No. 3, pp. 770-779.
Simon, Thorsten et al., Consolidation Treatment With Chimeric Anti-GD2-Antibody ch14.18 in Children Older Than 1 Year With Metastatic Neuroblastoma, Journal of Clinical Oncology, 2004, vol. 22, No. 17, pp. 3549-3557.
Spratlin, Jennifer L. et al., Phase I Pharmacologic and Biologic Study of Ramucirumab (IMC-1121B), a Fully Human Immunoglobulin G1 Monoclonal Antibody Targeting the Vascular Endothelial Growth Factor Receptor-2, Journal of Clinical Oncology, 2010, vol. 28, No. 5, pp. 780-787.
Steinfield, Serge et al., Epratuzumab (humanized anti-CD22 antibody) in autoimmune diseases, Expert Opinion, 2006, vol. 6, No. 9, pp. 943-949.
Stevenson, Frazier et al., The N-terminal propiece of interleukin 1a is a transforming nuclear oncoprotein, Proc. Natl. Acad. Sci. USA, 1997, vol. 94, No #, pp. 508-513.
Sullivan, David et al., Effect of a Monoclonal Antibody to PCSK9 on Low-Density Lipoprotein Cholesterol Levels in Statin-Intolerant Patients the GAUSS Randomized Trial, JAMA, 2012, vol. 308, No. 23, pp. 1-10.0.
Sun, Jian, et al., B lymphocyte stimulator: a new target for treating B cell malignancies, Chinese Medical Journal, 2008; vol. 12, No. 14, pp. 1319-1323.
Tanaka, Toshio et al., Targeting Interleukin-6: All the Way to Treat Autoimmune and Inflammatory Diseases, International Journal of Biological Sciences, 2012, vol. 8 No. 9, pp. 1227-1236.
Toffoli1, Giuseppe et al., Overexpression of Folate Binding Protein in Ovarian Cancers, 1997, Int. J. Cancer (Pred. Oncol.):vol. 74, No. #, pp. 193-198.
van Bezooijen, Rutger L. et al., Sclerostin Is an Osteocyte-expressed Negative Regulator of Bone Formation, But Not a Classical BMP Antagonist, The Journal of Experimental Medicine, 2004, vol. 199, No. 6, pp. 805-814.
van Bezooijen, Rutger L et al., Wnt but Not BMP Signaling Is Involved in the Inhibitory Action of Sclerostin on BMP-Stimulated Bone Formation, Journal of Bone and Mineral Research, 2007, vol. 22, No. 1, pp. 1-10.
van Cruijsen, Hester et al., Tissue micro array analysis of ganglioside N-glycolyl GM3 expression and signal transducer and activator of transcription (STAT)-3 activation in relation to dendritic cell infiltration and microvessel density in non-small cell lung cancer, BMC Cancer, 2009, vol. 9, No. 180, pp. 1-9.
Wallace, Daniel J. et al., Epratuzumab Demonstrates Clinically Meaningful Improvements in Patients with Moderate to Severe Systemic Lupus Erythematosus (SLE) Results from EMBLEM, a Phase IIB Study, ACR Concurrent Abstract Sessions, Systemic Lupus Enrthematosus—Clinical Aspects and Treatment: New Therapies, 2010, No Vol., pp. 1452.
Wallace, Daniel J et al., Efficacy and safety of epratuzumab in patients with moderate/severe active systemic lupus erythematosus: results from EMBLEM, a phase IIB, randomised, double-blind, placebo-controlled, multicentre study, Ann Rheum Dis, 2014;vol. 73, No #, pp. 183-190.
Wechsler, Michael E. et al., Novel targeted therapies for eosinophilic disorders, J Allergy Clin Immunol., 2012; vol. 130, No. 3, pp. 563-571.
Werman, Ariel et al., The precursor form of IL-1_is an intracrine proinflammatory activator of transcription, PNAS, 2004, vol. 101, No. 8, pp. 2434-2439.

WHO Drug Information, International Nonproprietary Names for Pharmaceutical Substances (INN),2013, vol. 27, No. 4, pp. 1-60.
WHO Drug Information, International Nonproprietary Names for Pharmaceutical Substances (INN), 2012, vol. 26, No. 4, pp. 1-71.
WHO Drug Information, International Nonproprietary Names for Pharmaceutical Substances (INN), 2011, vol. 25, No. 3, pp. 1-46.
WHO Drug Information, International Nonproprietary Names for Pharmaceutical Substances (INN), 2012, vol. 26, No. 2, pp. 1-79.
WHO Drug Information, International Nonproprietary Names for Pharmaceutical Substances (INN), 2012, vol. 26, No. 3, pp. 1-36.
Winkler, David G. et al. Osteocyte control of bone formation via sclerostin, a novel BMP antagonist , The EMBO Journal, 2003, vol. 22 No. 23 pp. 6267-6276.
Yang, Richard K. et al., Anti-GD2 Strategy in the Treatment of Neuroblastoma, Drugs Future, 2010 ; vol. 35, No. 8, pp. 1-15.
Yu, Alice et al., Phase I Truak of a Human-Mouse Chimeric Ant-Disialoganglioside Monoclonal Antibody ch14.18 in Patients with Refractory Neuroblastoma, and Osteosarcoma, Journal of Clinical Oncology1998, , vol. 16, No. 6, pp. 2169-2180.
Zheng, Yue et al. Intracellular Interleukin-1 Receptor 2 Binding Prevents Cleavage and Activity of Interleukin-1a, Controlling Necrosis-Induced Sterile Inflammation, Immunity,2013, vol. 38, No #, pp. 285-295.
Zhu, Min et al., Population Pharmacokinetics of Rilotumumab, a Fully Human Monoclonal Antibody Against Hepatocyte Growth Factor, in Cancer Patients, Journal of Pharmaceutical Sciences, 2014, vol. 328 No #, pp. 328-336.
Zhu, Zhenping et al., Inhibition of Vascular Endothelial Growth Factor-induced Receptor Activation with Anti-Kinase Insert Domain-containing Receptor Single-Chain Antibodies from a Phage Display Library, Cancer Research, 1998 vol. 58, No # pp. 3209-3214.
Zhu, Z et al, Inhibition of human leukemia in an animal model with human antibodies directed against vascular endothelial growth factor receptor 2. Correlation between antibody affinity and biological activity, Leukemia, 2003), vol. 17, pp. 604-611.
Zia-Amirhosseini, P. et al., Pharmacokinetics and Pharmacodynamics of SB-240563, a Humanized Monoclonal Antibody Directed to Human Interleukin-5, in Monkeys, The Journal of Pharmacology and Experimental Therapeutics, 1999, vol. 291, No. 3, pp. 1060-1067.
Stockinger, Walter et al., The PX-domain Protein SNX17 Interacts With Members of the LDL Receptor Family and Modulates Endocytosis, The EMBO Journal, 2002, vol. 21, No. 16 pp. 4259-4267.
Sorrentino, Vincenzo et al., Post-transcriptional regulation of lipoprotein receptors by the E3-ubiquitin ligase inducible degrader of the low-density lipoprotein receptor, Current Opinion, 2012, vol. 23, No. 3, pp. 213-219.
Zelcer, Noam et al., LXR Regulates Cholesterol Uptake through Idol-dependent Ubiquitination of the LDL Receptor, Science, 2009; vol. 325, No. 5936, pp. 100-104.
Zhang , Li et al, Both K63 and K48 ubiquitin linkages signal lysosomal degradation of the LDL receptor, Journal of Lipid Research, 2013, vol. 54, No #, pp. 1410-1420.
Lozier, Jay N , Factor IX Padua: them that have, give , Blood, 2012, vol. 120, No #, pp. 4452-4453.
Simioni, Paolo et al., X-Linked Thrombophilia with a Mutant Factor IX (Factor IX Padua), The New England Journal of Medicine, 2009, vol. 361, No. 17, pp. 1671-1675.
Cornett, Jeff et al. Update of Clinicla Trials to Cure Hemophilia, Hemophilia of Georgia, Dec. 12, 2013, No Vol. pp. 1-2.
Raschke, Silja et al., Adipo-Myokines: Two Sides of the Same Coin—Mediators of Inflammation and Mediators of Exercise, Mediators of Inflammation, 2013, vol. 2013, Article ID 320724, pp. 1-16.
Podbregar, Matej et al., Cytokine Response of Cultured Skeletal Muscle Cells Stimulated with Proinflammatory Factors Depends on Differentiation Stage, The Scientific World Journal, 2013, vol. 2013, Article ID 617170, pp. 1-8.
Guerrero-Ca'zares, Hugo et al. Biodegradable Polymeric Nanoparticles Show High Efficacy and Specificity at DNA Delivery to Human Glioblastoma in Vitro and in Vivo, ACS Nano, 2014, No Vol., No #, pp. 1-14.

(56) References Cited

OTHER PUBLICATIONS

Dahlman, James E. et al., In vivo endothelial siRNA delivery using polymeric nanoparticles with low molecular weight, Nature Nanotechnology, 2014, No Vol. #, pp. 1-8.
Kozielski, Kristen L. et al., Bioreducible Cationic Polymer-Based Nanoparticles for Efficient and Environmentally Triggered Cytoplasmic siRNA Delivery to Primary Human Brain Cancer Cells, ACS Nano, 2014, Vol. 8, 'No. 4', pp. 3232-3241.
M. Kanapathipillai, et al., Nanoparticle targeting of anti-cancer drugs that alter intracellular signaling or influence the tumor microenvironment, Adv. Drug Deliv. Rev. (2014), pp. 1-12.
Seldin, Marcus M. et al., Regulation of tissue crosstalk by skeletal muscle-derived myonectin and other myokines, Adipocyte, 2012, vol. 1, No. 4, pp. 200-202.
Hamrick, Mark W. et al., The skeletal muscle secretome: an emerging player in muscle-bone crosstalk, BoneKEy Reports, 2012, vol. 1, Article No. 60, pp. 1-5.
Compton, J., Nucleic Acid Sequence-Based Amplification, Nature, 1991, vol. 350, No#, pp. 91-92. (Abstract Only).
International Search Report, PCT/US2014/020206, dated May 23, 2014, pp. 1-9.
Kariko, Katalin, et al., Impacts of Nucleoside Modification on RNA-mediated activation of toll-like receptors, 2008, Nucleic Acides in Innate Immunity, No Vol., pp. 171-188.
Cystic Fibrosis Transmembrane Conductance Regulator; cystic fibrosis transmembrane conductance regulator [*Homo sapiens*]; NCBI, 2010, No Vol., pp. 1-5.
Miotti, S. et al., Characterization of Human Ovarian Carcinoma-Associated Antigens Defined by Novel Monoclonal Antibodies with Tumor-Restricted Specificity, Intl. J. Cancer, 1987, vol. 39, No #, pp. 297-303.
Robak, Tadeusz et al., Current and Emerging Treatments for Chrinic Lymphocytic Leukaemia, Drugs, 2009, vol. 69, No. 17, pp. 2415-2449.
Hutas, Ocrelizumab, a humanized monoclonal antibody against CD20 for inflammatory disorders and B-cell malignancies, Curr Opin Investig Drugs, 2008, vol. 11, No #, pp. 1206-1216. (Abstract Only).
Verma, Sandeep, et.al. , Functional Tuning of Nucleic Acids by Chemical Modifications: Tailored Oligonucleotides as Drugs, Devices, and Diagnodtics, The Japan Chemical Journal Forum and Wiley Periodicals, Inc., 2003, Chem Rec 3, pp. 51-60.
Argininosuccinate synthetase; argininosuccinate synthetase, isoform CRA_b {*Homo sapiens*} NCBI, Dec. 18, 2006, No Vol., pp. 1-3.
Lee et al., Hepatocyte Gene Therapy in a Large Animal: A Neonatal Bovine Model of Citrullinemia, PNAS, 1999, vol. 96, No #, pp. 3981-3986.
Strausberg et al., National Cancer Institute, Cancer Genome Anatomy Project, Tumor Gene Index, gene accession No. BE136127, 1997 pp. ??.
Lysosomal Acid Lipase (lysosomal acid lipase/ cholesteryl ester hydrolase isoform 1 precursor [*Homo sapiens*]; NCBI, 2010, No Vol., pp. 1-3.
Gu, Minghao et al., Combinatorial synthesis with high throughput discovery of protein-resistant membrane surfaces, BioMaterials, 2013, vol. 34, No#., pp. 6133-6138.
Glucosylceramidase, glucosylceramidase isoform 1precursor [*Homo sapiens*]; NCBI, 2010, No Vol., pp. 1-4.
Robbins et al., Retroviral Vectors for Use in Human Gene Therapy for Cancer, Gaucher Disease, and Arthritis; Annals of the New York Academy of Sciences, 2006, vol. 716, No. 1, pp. 72-89.
Bertrand, Edouard et al., The snoRNPs and Related Machines: Ancient Devices That Mediate Maturation of rRNA and Other RNAs, 2004, Chapter 13, pp. 223-257.
Zhao, Xiansi et al., Regulation of Nuclear Receptor Activity by a Pseudouridine Synthase through Posttranscriptional Modification of Steroid Receptor RNA Activator, Molecular Cell, 2004, vol. 15, No #, pp. 549-558.
Zhao, Xinliang, Detection and quantitation of RNA base modifications, RNA, 2004, vol. 10:, pp. 996-1002.

Bosma, Piter Jabik et al., Inherited disorders of bilirubin metabolism, Journal of Hepatology, 2003, vol. 38, No #, pp. 107-117.
Chowdhury, Jayanta R. et al., Bilirubin Mono- and Diglucuronide Formation by Human Liver In Vitro: Assay by High-Pressure Liquid Chromatography, Hepatology, 1981, vol. 1, No. 6, pp. 622-627.
Chowdhury, Jayanta R. et al., Molecular Basis for the Lack of Bilirubin-specific and 3-Methylcholanthrene-inducibleUDP-GlucuronosyltransferaseActivities in Gunn Rats, TheJ Ournaofl B Iological Chemistry, 1991, vol. 266, No. 27, pp. 18294-18298.
Chowdhury, Namita et al., Isolation of Multiple Normal and Functionally Defective Forms of Uridine Diphosphate-Glucuronosyltransferase from Inbred Gunn Rats, J. Clin. Invest, 1987, vol. 79, No. #, pp. 327-334.
Crigler, John et al. Society Transactions, Society for Pediatric Research, 31st Annual Meeting, Atlantic City, Congenital Familial Nonhemolytic Jaundice with Kernicterus: A New Clinical Entity, 1951, 3rd session, no Vol. pp. 1-3.
Miyagi, Shogo J. et al., The Development of UDP-Glucuronosyltransferases 1A1 and 1A6 in the Pediatric Liver, Drug Metabolism and Disposition, 2011, vol. 39, No. 5, pp. 912-919.
Gunn, Charles, Hereditary Acholuric Jaundice in the Rat, Can M.J., 1944, vol. 50, No #, pp. 230-237.
Brockton, NT et al, UGT1A1 polymorphisms and colorectal cancer susceptibility, Cancer, Gut, 2002; vol. 50, pp. 747-748.
Iyanagi, Takashi et al., Molecular Basis of Multiple UDP-Glucuronosyltransferase Isoenzyme Deficiencies in the Hyperbilirubinemic Rat (Gunn Rat), 1991, vol. 266, No. 35, pp. 24048-24052.
Kadakol, Ajit et al., Genetic Lesions of Bilirubin Uridine-diphosphoglucuronate Glucuronosyltransferase (UGT1A1) Causing Crigler-Najjar and Gilbert Syndromes: Correlation of Genotype to Phenotype, Human Mutation, 2000, vol. 16, No #, pp. 297-306.
Miranda, Paula S. Montenegro et al., Towards Liver-Directed Gene Therapy for Crigler-Najjar Syndrome, Current Gene Therapy, 2009, vol. 9, pp. 72-82.
Pastore, Nunzia et al., Sustained Reduction of Hyperbilirubinemia in Gunn Rats After Adeno-Associated Virus-Mediated Gene Transfer of Bilirubin UDP-Glucuronosyltransferase Isozyme 1A1 to Skeletal Muscle, Human Gene Therapy, 2012, vol. 23, No #, pp. 1082-1089.
Strassburg, Christian P. et al., Hyperbilirubinemia syndromes (Gilbert-Meulengracht, Crigler-Najjar, Dubin-Johnson, and Rotor syndrome), Best Practice & Research Clinical Gastroenterology, 2010, vol. 24, No. #, pp. 555-571.
Sugatani, Junko et al., Transcriptional Regulation of Human UGT1A1 Gene Expression: Activated Glucocorticoid Receptor Enhances constitutive Androstane Receptor/Pregnane X Receptor-Mediated UDP-Glucuronosyltransferase 1A1 Regulation with Glucocorticoid Receptor-Interacting Protein 1, Molecular Pharmacology, 2013, vol. 67, No. 3, pp. 845-855.
Batshaw, Mark L. et al., Treatment of Inborn Errors of Urea Synthesis, The New England Journal of Medicine, 1982, vol. 306, No. 23, pp. 1387-1392.
Batshaw, Mark L. Et al., Risk of Serious Illness in Heterozygotes for Ornithine Transcarbamylase Deficiency, J. Pediatr, 1986, vol. 108, No. 2, pp. 236-241.
Braissant, Olivier et al., Current concepts in the pathogenesis of urea cycle disorders, Molecular Genetics and Metabolism, 2010, vol. 100, pp. S3-S12.
Hodges, Peter E. et al., The spf h mouse: A missense mutation in the ornithine transcarbamylase gene also causes aberrant mRNA splicing, Genetics, Proc. Nati. Acad. Sci. USA, 1989,vol. 86, pp. 4142-4146.
Marini, Juan C et al., Phenylbutyrate improves nitrogen disposal via an alternative pathway without eliciting an increase in protein breakdown and catabolism in control and ornithine transcarbamylase-deficient patients, Am J Clin Nutr , 2011, vol. 93, No. #, pp. 1248-1254.
Rosenberg, Leon E., et al., Biogenesis of Ornithine Transcarbamylase in sprsh Mutant Mice: Two Cytoplasmic Precursors, One Mitochondrial Enzyme, Science,1983, vol. 222, No Vol. #, pp. 426-428.

(56) References Cited

OTHER PUBLICATIONS

Summar, MD, Marshall et al., Current strategies for the management of neonatal urea cycle disorders, The Journal of Pediatrics, 2001, vol. 138, No. 1, pp. s30-s39.

Walker, V., Ammonia toxicity and its prevention in inherited defects of the urea cycle, Diabetes, Obesity and Metabolism, 2009, vol. 11, No #, pp. 823-835.

Whitington, P. F. et al., Liver transplantation for the treatment of urea cycle disorders, J. Inher. Metab. Dis., 1998, vol. 21 (Suppl 1) pp. 112-118.

Wilcken, Bridget et al., Problems in the management of urea cycle disorders, Molecular Genetics and Metabolism, 2004, vol. 81, No #, S86-S91.

Cosman, David et al., ULBPs, Novel MHC Class I—Related Molecules, Bind to CMV Glycoprotein UL16 and Stimulate NK Cytotoxicity through the NKG2D Receptor, Immunity,2001, vol. 14, No Vol. pp. 123-133.

Croft, Michael et al., TNF superfamily in inflammatory disease: translating basic insights, Trends Immunol, 2012; vol. 33, No. 3, pp. 144-152.

Friese, Manuel A. et al., MICA/NKG2D-Mediated Immunogene Therapy of Experimental Gliomas, Cancer Res, 2003, vol. 63, pp. 8996-9006.

Gomes, Anita Q. et al., Non-classical major histocompatibility complex proteins as determinants of tumour immunosurveillance, 2007, EMBO reports, vol. 8, No. 11, pp. 1024-1030.

Guo, Z Sheng et al., Life after death: targeting high mobility group box 1 in emergent cancer therapies, Am J Cancer Res, 2013;vol. 3, No. 1 pp. 1-20.

Kane, Lawrence P. et al., TIM Proteins and Immunity, J Immunol., 2010; vol. 184, No. (6): 2743-2749.

Lanca, Telma et al., The MHC class Ib protein ULBP1 is a nonredundant determinant of leukemia/lymphoma susceptibility to gd T-cell cytotoxicity, Blood, 2010, vol. 115, No #, pp. 2407-2411.

Lee, Sylvia et al., Cytokines in Cancer Immunotherapy , Cancers, 2011, vol. 3, No. #, pp. 3856-3893.

Lee, Judong et al., TIM Polymorphisms—Genetics and Function, Genes Immun. 2011, vol. 12, No. 8, pp. 595-604.

Raghavan, Malini et al., Calreticulin in the immune system: ins and outs, Cell Press, Trends in Immunology, 2013, vol. 34, No. 1, pp. 13-21.

Malone, R.W. et al., Cationic liposome-mediated RNA transfection. Proc Natl Acad Sci U S A. Aug. 1989;86(16):6077-81.

Niu, M.C., Glucose-6-Phosphate: Re-examination of the RNA-Induced Activity in Mouse Ascites Tumor Cells. Science. 1965, 148:513-6.

Niu, M.C., Mode of Action of the Exogenous Ribonucleic Acid in Cell Function. Natl Cancer Inst. Monogr. 1964, 13:167-77.

Niu, M.C., et al., Poly(A)-attached RNA as activator in embryonic differentiation. Proc Soc Exp Biol Med. Oct. 1974;147(1):318-22.

Niu, M.C., et al., Presence of liver-forming fraction in fish egg mRNAs detected by its ability to encode albumin synthesis. Scientia Sinica, 1980, 23(4):510-6.

Niu, M.C., et al., Re-examination of the DNA-mediated transformation in goldfish. Scientia Sinica, 1983, 24(7):700-7.

Niu, M.C., The Development of Tubular heart in RNA-Treated Post-Nodal pieces of Chick Blastoderm. J Embryol. Exp. Morphol., 1973, 29:485-501.

Niu, M.C., The Effect of mRNA on Nuclear Activity in Developing Systems. 1980, 415-33.

Niu, M.C., The role of Exogenous Heart-RNA in Development of the Chick Embryo Cultivated In Vitro. J Embryol. Exp. Morphol., 1970, 64:57-64.

Niu, M.C., Thymus Ribonucleic Acid and Embryonic Differentiation. PNAS, 1958, 44:1264-1274.

Niu, M.C. et al., Transfer of information from mRNA to chromosomes by reverse transcription in early development of goldfish eggs. Cellular and Molecular Biology, 1989, 35(3):333-45.

Niu, M.C., VII. New Approaches to the Problem of Embryonic Induction. Cellular Mechanisms, Differentiation and Growth. 1956, 155-71.

Oberhauser, B. et al., Effective incorporation of 2'-O-methyloligoribonucleotides into liposomes and enhanced cell association through modification with thiocholesterol. Nucleic Acids Res. Feb. 11, 1992;20(3):533-8.

Occhiogrosso, G., et al., Prolonged convection-enhanced delivery into the rat brainstem. Neurosurgery. Feb. 2003; 52(2): 388-394.

Odens, M., Prolongation of the Life Span in Rats. Journal of the American Geriatrics Soc. Oct. 1973; 11(10):450-1.

O'Doherty, U. et al., Human blood contains two subsets of dendritic cells, one immunologically mature and the other immature. Immunology. Jul. 1994;82(3):487-93.

Ofengand, J. et al., The function of pseudouridylic acid in transfer ribonucleic acid: II. Inhibition of amino acyl transfer ribonucleic acid-ribosome complex formation by ribothymidylyl-pseudouridylyl-cytidylyl-guanosine 3'-phosphate. J Biol Chem. Nov. 25, 1969; 244(22): 6241-6253.

Ohashi, H. et al., Efficient protein selection based on ribosome display system with purified components. Biochem Biophys Res Commun. Jan. 5, 2007;352(1):270-6. Epub Nov. 13, 2006.

Ohmichi, T. et al., Efficient bacterial transcription of DNA nanocircle vectors with optimized single-stranded promoters. Ohmichi T, Maki A, Kool ET. Proc Natl Acad Sci U S A. Jan. 8, 2002;99(1):54-9. Epub Dec. 18, 2001.

Okumura, K, et al., Bax mRNA therapy using cationic liposomes for human malignant melanoma. J Gene Med. 2008; 10: 910-917.

Owen, M. et al., Stromal stem cells: marrow derived osteogenic precursors. CIBA Foundation Symposium, 1988, 136:42-60.

Ozawa, T. et al., Amplification and analysis of cDNA generated from a single cell by 5'-RACE: application to isolation of antibody heavy and light chain variable gene sequences from single B cells. Biotechniques. Apr. 2006;40(4):469-70.

Padilla, R. et al., A Y639F/H784A T7 RNA polymerase double mutant displays superior properties for synthesizing RNAs with non-canonical NTPs. Nucleic Acids Res. Dec. 15, 2002;30(24):e138.

Paglia, P. et al., Murine dendritic cells loaded in vitro with soluble protein prime cytotoxic T lymphocytes against tumor antigen in vivo. J Exp Med. Jan. 1, 1996;183(1):317-22.

Painter, H., et al., 494. Topical delivery of mRNA to the murine lung and nasal epithelium. Mol Ther. 2004; 9: S187.

Palu, G. et al., In pursuit of new developments for gene therapy of human diseases. J Biotechnol. Feb. 5, 1999;68(1):1-13.

Palucka, A.K. et al., Taming cancer by inducing immunity via dendritic cells. Immunol Rev. Dec. 2007;220:129-50.

Papapetrou, E., et al., Stoichiometric and temporal requirements of Oct4, Sox2, Klf4, and c-Myc expression for efficient human iPSC induction and differentiation. Natl. Acad. Sci USA. Aug. 2009; 106: 12759-12764.

Paradi, E. et al., Changes in the content of modified nucleotides in wheat rRNA during greening. Biologia Plantarum. 2003/4; 47(1):33-8.

Park, I., et al., Reprogramming of human somatic cells to pluripotency with defined factors. Nature. Jan. 2008; 451(10): 141-146.

Parker, R. et al., Recognition of the TACTAAC box during mRNA splicing in yeast involves base pairing to the U2-like snRNA. Cell. Apr. 24, 1987;49(2):229-39.

Pascolo, S. Vaccination with messenger RNA (mRNA). Handb Exp Pharmacol. 2008; 183:221-235.

Passini, M.A. et al., AAV vector-mediated correction of brain pathology in a mouse model of Niemann-Pick A disease. Mol Ther. May 2005;11(5):754-62.

Passos, G.A. et al., In vivo induction of immunological memory to human tumor extract with poly (A)-containing immune RNA. Cell Mol Biol. 1988;34(2):157-64.

Paul, S., et al., How to improve R&D productivity: the pharmaceutical industry's grand challenge. Nat Reviews Drug Discovery. Mar. 2010; 9: 203-214.

Pays, E., Characterization of double-stranded ribonucleic acid sequences present in the initial transcription products of rat liver chromatin. Biochem J. Aug. 1, 1977;165(2):237-45.

(56) References Cited

OTHER PUBLICATIONS

Pearson, W.R. et al., Improved tools for biological sequence comparison. Proc Natl Acad Sci U S A. Apr. 1988;85(8):2444-8.

Peculis, B. RNA processing: pocket guides to ribosomal RNA. Curr Biol. Aug. 1, 1997;7(8):R480-2.

Peng, Z.H. et al., Synthesis and application of a chain-terminating dinucleotide mRNA cap analog. Org Lett. Jan. 24, 2002;4(2)161-4.

Peoples, G.E. et al., Breast and ovarian cancer-specific cytotoxic T lymphocytes recognize the same HER2/neu-derived peptide. Proc Natl Acad Sci U S A. Jan. 17, 1995;92(2):432-6.

Perche, F., et al., Enhancement of dedritic cells transfection in vivo and of vaccination against B16F10 melanoma with mannosylated histidylated lipopolyplexes loaded with tumor antigen messenger RNA. Nanomed: Nanotech, Bio, and Med. Aug. 2011; 7(4): 445-453.

Pesole, G. et al., Structural and functional features of eukaryotic mRNA untranslated regions. Gene. Oct. 3, 2001;276(1-2):73-81.

Pesole, G. et al., UTRdb and UTRsite: specialized databases of sequences and functional elements of 5' and 3' untranslated regions of eukaryotic mRNAs. Update 2002. Nucleic Acids Res. Jan. 1, 2002;30(1):335-40.

Petit, I., et al., G-CSF induces stem cell mobilization by decreasing bone marrow SDF-I and up-regulating CXCR4. Nature Immunology. Jul. 2002; 3(7): 687-694.

Phillips, J. et al., Antisense RNA Amplification: A Linear Amplification Method for Analyzing the mRNA Population from Single Living Cells. Methods. Dec. 1996;10(3):283-8.

Phizicky, E.M. et al., [31] Biochemical genomics approach to map activities to genes. Methods Enzymol. 2002;350:546-59.

Pollard, C., et al., Type I IFN counteracts the induction of antigen-specific immune responses by lipid-based delivery of mRNA vaccines. Mol Ther. Jan. 2013; 21(1): 251-259.

Ponsaerts, P. et al., Cancer immunotherapy using RNA-loaded dendritic cells. Clin Exp Immunol. Dec. 2013;134(3):378-84.

Ponsaerts, P. et al., Messenger RNA electroporation is highly efficient in mouse embryonic stem cells: successful FLPe- and Cre-mediated recombination. Gene Ther. Nov. 2004;11(21):1606-10.

Ponsaerts, P., et al., Highly efficient mRNA-based gene transfer in feeder-free cultured H9 human embryonic stem cells. Cloning and Stem Cells. 2004; 6(3): 211-216.

\* cited by examiner

98N12-5 (TETA5-LAP)

DLin-DMA

DLin-K-DMA (2,2-Dilinoleyl-4-dimethylaminomethyl-[1,3]-dioxolane)

DLin-KC2-DMA

DLin-MC3-DMA

C12-200

PRIOR ART

MODIFIED POLYNUCLEOTIDES ENCODING SEPTIN-4

CROSS REFERENCE TO RELATED APPLICATIONS

This application is a continuation of International Patent Application No PCT/US2013/030070, filed Mar. 9, 2013, entitled Modified Polynucleotides for the Production of Oncology-Related Proteins and Peptides which claims priority to U.S. Provisional Patent Application No. 61/681,742, filed, Aug. 10, 2012, entitled Modified Polynucleotides for the Production of Oncology-Related Proteins and Peptides, U.S. Provisional Patent Application No. 61/737,224, filed Dec. 14, 2012, entitled Terminally Optimized Modified RNAs, International Application No PCT/US2012/069610, filed Dec. 14, 2012, entitled Modified Nucleoside, Nucleotide, and Nucleic Acid Compositions, U.S. Provisional Patent Application No. 61/618,862, filed Apr. 2, 2012, entitled Modified Polynucleotides for the Production of Biologics, U.S. Provisional Patent Application No. 61/681,645, filed Aug. 10, 2012, entitled Modified Polynucleotides for the Production of Biologics, U.S. Provisional Patent Application No. 61/737,130, filed Dec. 14, 2012, entitled Modified Polynucleotides for the Production of Biologics, U.S. Provisional Patent Application No. 61/618,866, filed Apr. 2, 2012, entitled Modified Polynucleotides for the Production of Antibodies, U.S. Provisional Patent Application No. 61/681,647, filed Aug. 10, 2012, entitled Modified Polynucleotides for the Production of Antibodies, U.S. Provisional Patent Application No. 61/737,134, filed Dec. 14, 2012, entitled Modified Polynucleotides for the Production of Antibodies, U.S. Provisional Patent Application No. 61/618,868, filed Apr. 2, 2012, entitled Modified Polynucleotides for the Production of Vaccines, U.S. Provisional Patent Application No. 61/681,648, filed Aug. 10, 2012, entitled Modified Polynucleotides for the Production of Vaccines, U.S. Provisional Patent Application No. 61/737,135, filed Dec. 14, 2012, entitled Modified Polynucleotides for the Production of Vaccines, U.S. Provisional Patent Application No. 61/618,870, filed Apr. 2, 2012, entitled Modified Polynucleotides for the Production of Therapeutic Proteins and Peptides, U.S. Provisional Patent Application No. 61/681,649, filed Aug. 10, 2012, entitled Modified Polynucleotides for the Production of Therapeutic Proteins and Peptides, U.S. Provisional Patent Application No. 61/737,139, filed Dec. 14, 2012, Modified Polynucleotides for the Production of Therapeutic Proteins and Peptides, U.S. Provisional Patent Application No. 61/618,873, filed Apr. 2, 2012, entitled Modified Polynucleotides for the Production of Secreted Proteins, U.S. Provisional Patent Application No. 61/681,650, filed Aug. 10, 2012, entitled Modified Polynucleotides for the Production of Secreted Proteins, U.S. Provisional Patent Application No. 61/737,147, filed Dec. 14, 2012, entitled Modified Polynucleotides for the Production of Secreted Proteins, U.S. Provisional Patent Application No. 61/618,878, filed Apr. 2, 2012, entitled Modified Polynucleotides for the Production of Plasma Membrane Proteins, U.S. Provisional Patent Application No. 61/681,654, filed Aug. 10, 2012, entitled Modified Polynucleotides for the Production of Plasma Membrane Proteins, U.S. Provisional Patent Application No. 61/737,152, filed Dec. 14, 2012, entitled Modified Polynucleotides for the Production of Plasma Membrane Proteins, U.S. Provisional Patent Application No. 61/618,885, filed Apr. 2, 2012, entitled Modified Polynucleotides for the Production of Cytoplasmic and Cytoskeletal Proteins, U.S. Provisional Patent Application No. 61/681,658, filed Aug. 10, 2012, entitled Modified Polynucleotides for the Production of Cytoplasmic and Cytoskeletal Proteins, U.S. Provisional Patent Application No. 61/737,155, filed Dec. 14, 2012, entitled Modified Polynucleotides for the Production of Cytoplasmic and Cytoskeletal Proteins, U.S. Provisional Patent Application No. 61/618,896, filed Apr. 2, 2012, entitled Modified Polynucleotides for the Production of Intracellular Membrane Bound Proteins, U.S. Provisional Patent Application No. 61/668,157, filed Jul. 5, 2012, entitled Modified Polynucleotides for the Production of Intracellular Membrane Bound Proteins, U.S. Provisional Patent Application No. 61/681,661, filed Aug. 10, 2012, entitled Modified Polynucleotides for the Production of Intracellular Membrane Bound Proteins, U.S. Provisional Patent Application No. 61/737,160, filed Dec. 14, 2012, entitled Modified Polynucleotides for the Production of Intracellular Membrane Bound Proteins, U.S. Provisional Patent Application No. 61/618,911, filed Apr. 2, 2012, entitled Modified Polynucleotides for the Production of Nuclear Proteins, U.S. Provisional Patent Application No. 61/681,667, filed Aug. 10, 2012, entitled Modified Polynucleotides for the Production of Nuclear Proteins, U.S. Provisional Patent Application No. 61/737,168, filed Dec. 14, 2012, entitled Modified Polynucleotides for the Production of Nuclear Proteins, U.S. Provisional Patent Application No. 61/618,922, filed Apr. 2, 2012, entitled Modified Polynucleotides for the Production of Proteins, U.S. Provisional Patent Application No. 61/681,675, filed Aug. 10, 2012, entitled Modified Polynucleotides for the Production of Proteins, U.S. Provisional Patent Application No. 61/737,174, filed Dec. 14, 2012, entitled Modified Polynucleotides for the Production of Proteins, U.S. Provisional Patent Application No. 61/618,935, filed Apr. 2, 2012, entitled Modified Polynucleotides for the Production of Proteins Associated with Human Disease, U.S. Provisional Patent Application No. 61/681,687, filed Aug. 10, 2012, entitled Modified Polynucleotides for the Production of Proteins Associated with Human Disease, U.S. Provisional Patent Application No. 61/737,184, filed Dec. 14, 2012, entitled Modified Polynucleotides for the Production of Proteins Associated with Human Disease, U.S. Provisional Patent Application No. 61/618,945, filed Apr. 2, 2012, entitled Modified Polynucleotides for the Production of Proteins Associated with Human Disease, U.S. Provisional Patent Application No. 61/681,696, filed Aug. 10, 2012, entitled Modified Polynucleotides for the Production of Proteins Associated with Human Disease, U.S. Provisional Patent Application No. 61/737,191, filed Dec. 14, 2012, entitled Modified Polynucleotides for the Production of Proteins Associated with Human Disease, U.S. Provisional Patent Application No. 61/618,953, filed Apr. 2, 2012, entitled Modified Polynucleotides for the Production of Proteins Associated with Human Disease, U.S. Provisional Patent Application No. 61/681,704, filed Aug. 10, 2012, entitled Modified Polynucleotides for the Production of Proteins Associated with Human Disease, U.S. Provisional Patent Application No. 61/737,203, filed Dec. 14, 2012, entitled Modified Polynucleotides for the Production of Proteins Associated with Human Disease, U.S. Provisional Patent Application No. 61/618,961, filed Apr. 2, 2012, entitled Dosing Methods for Modified mRNA, U.S. Provisional Patent Application No. 61/648,286, filed May 17, 2012, entitled Dosing Methods for Modified mRNA, the contents of each of which are herein incorporated by reference in its entirety.

This application is also related to International Publication No. PCT/US2012/58519, filed Oct. 3, 2012, entitled Modified Nucleosides, Nucleotides, and Nucleic Acids, and Uses Thereof and International Publication No. PCT/US2012/

69610, filed Dec. 14, 2012, entitled Modified Nucleoside, Nucleotide, and Nucleic Acid Compositions.

The instant application is also related to co-pending applications, each filed concurrently herewith on Mar. 9, 2013, (PCT/US13/030,062) entitled Modified Polynucleotides for the Production of Biologics and Proteins Associated with Human Disease; (PCT/US13/030,063) entitled Modified Polynucleotides; (PCT/US13/030,064), entitled Modified Polynucleotides for the Production of Secreted Proteins; (PCT/US13/030,064), entitled Modified Polynucleotides for the Production of Secreted Proteins; (PCT/US13/030,059), entitled Modified Polynucleotides for the Production of Membrane Proteins; (PCT/US13/030,066), entitled Modified Polynucleotides for the Production of Cytoplasmic and Cytoskeletal Proteins; (PCT/US13/030,067), entitled Modified Polynucleotides for the Production of Nuclear Proteins; (PCT/US13/030,060), entitled Modified Polynucleotides for the Production of Proteins; (PCT/US13/030,061), entitled Modified Polynucleotides for the Production of Proteins Associated with Human Disease; and (PCT/US13/030,068), entitled Modified Polynucleotides for the Production of Cosmetic Proteins and Peptides, the contents of each of which are herein incorporated by reference in its entirety.

REFERENCE TO SEQUENCE LISTING

The present application is being filed along with a Sequence Listing in electronic format. The Sequence Listing file entitled MNC2USCON4SQLST.txt, created on Dec. 12, 2013 which is 91,363,970 Bytes in size. The information in electronic format of the sequence listing is incorporated by reference in its entirety.

REFERENCE TO LENGTHY TABLE

The specification includes a lengthy Table 6. Lengthy Table 6 has been submitted via EFS-Web in electronic format as follows: File name: MNC2TBL.txt, Date created: Dec. 13, 2013; File size: 538,729 Bytes and is incorporated herein by reference in its entirety. Please refer to the end of the specification for access instructions.

(immunotherapy, hormone manipulation, enzymatic inhibition), diagnosis and determination of cancer type (molecular markers for breast, prostate, colon and cervical cancer for example). With the host of undesired consequences brought about by standard treatments such as chemotherapy and radiotherapy used today, genetic therapy for the manipulation of disease-related peptides provides a more targeted approach to disease diagnosis, treatment and management.

To this end, the inventors have shown that certain modified mRNA sequences have the potential as therapeutics with benefits beyond just evading, avoiding or diminishing the immune response. Such studies are detailed in published co-pending applications International Application PCT/US2011/046861 filed Aug. 5, 2011 and PCT/US2011/054636 filed Oct. 3, 2011, International Application number PCT/US2011/054617 filed Oct. 3, 2011, the contents of which are incorporated herein by reference in their entirety.

The present invention addresses this need by providing nucleic acid based compounds or polynucleotide-encoding nucleic acid-based compounds (e.g., modified mRNA or mmRNA) which encode an oncology-related polypeptide of interest and which have structural and/or chemical features that avoid one or more of the problems in the art.

SUMMARY OF THE INVENTION

Described herein are compositions, methods, processes, kits and devices for the design, preparation, manufacture and/or formulation of modified mRNA (mmRNA) molecules encoding at least one oncology-related polypeptide of interest.

The present invention provides a method of treating a disease, disorder and/or condition in a subject in need thereof by increasing the level of an oncology-related polypeptide of interest comprising administering to said subject an isolated polynucleotide encoding said oncology-related polypeptide. The disease, disorder and/or condition may include, but is not limited to, adrenal cortical cancer, advanced cancer, anal cancer, aplastic anemia, bileduct cancer, bladder cancer, bone cancer, bone metastasis, brain tumors, brain cancer, breast

---

LENGTHY TABLES

The patent contains a lengthy table section. A copy of the table is available in electronic form from the USPTO web site (http://seqdata.uspto.gov/?pageRequest=docDetail&DocID=US09149506B2). An electronic copy of the table will also be available from the USPTO upon request and payment of the fee set forth in 37 CFR 1.19(b)(3).

---

FIELD OF THE INVENTION

The invention relates to compositions, methods, processes, kits and devices for the design, preparation, manufacture and/or formulation of oncology-ralted polynucleotides, primary constructs and modified mRNA molecules (mmRNA).

BACKGROUND OF THE INVENTION

Cancer is a disease characterized by uncontrolled cell division and growth within the body. In the United States, roughly a third of all women and half of all men will experience cancer in their lifetime. Polypeptides are involved in every aspect of the disease including cancer cell biology (carcinogenesis, cell cycle suppression, DNA repair and angiogenesis), treatment cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor and secondary cancers caused by cancer treatment.

The present invention provides a method of reducing, eliminating, or preventing tumor growth in a subject in need thereof by increasing the level of an oncology-related polypeptide of interest comprising administering to said subject an isolated polynucleotide encoding said oncology-related polypeptide. The tumor growth may be associated with or results from a disease, disorder and/or condition such as, but not limited to, adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor and secondary cancers caused by cancer treatment.

The present invention provides a method of reducing and/or ameriorating at least on symptom of cancer in a subject in need thereof by increasing the level of an oncology-related polypeptide of interest comprising administering to said subject an isolated polynucleotide encoding said oncology-related polypeptide.

The present invention provides an isolated polynucleotide comprising a first region of linked nucleosides, said first region encoding the oncology-related polypeptide of interest, a first flanking region located at the 5' terminus of said first region comprising a sequence of linked nucleosides selected from the group consisting of the native 5' untranslated region (UTR) of any of SEQ ID NOs: 4704-9203, SEQ ID NOs: 1-4 and functional variants thereof and a second flanking region located at the 3' terminus of said first region comprising a sequence of linked nucleosides selected from the group consisting of the native 3' UTR of any of SEQ ID NOs: 4704-9203, SEQ ID NOs: 5-21 and functional variants thereof and a 3' tailing sequence of linked nucleosides. The isolated polynucleotide may further be substantially purified.

Further, the first region of the isolated polynucleotides of the present may comprise two stop codons. In one embodiment, the first region further comprises a first stop codon "TGA" and a second stop codon selected from the group consisting of "TAA," "TGA" and "TAG."

The 3' tailing sequence of the isolated polynucleotides of the present invention may further include linked nucleosides such as, but not limitd to, a poly-A tail of approximately 130 nucleotides and a poly A-G quartet.

The first flanking region of the isolated polynucleotide may further comprise at least one 5' terminal cap such as, but not limited to, Cap0, Cap1, ARCA, inosine, N1-methyl-guanosine, 2' fluoro-guanosine, 7-deaza-guanosine, 8-oxo-guanosine, 2-amino-guanosine, LNA-guanosine, and 2-azido-guanosine.

The nucleotides of the isolated polynucleotides of the present invention may comprise at least two modifications and a translatable region. The modification may be on at least one nucleoside and/or the backbone of said nucleotides, on both a nucleoside and a backbone linkage or on a sugar of the nucleoside. The modification may comprise replacing at least one phosphodiester linkage with a phosphorothioate linkage. The modification may include, but are not limited to, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine. The backbone linkage may be modified by the replacement of one or more oxygen atoms. The nucleobase modified may be selected from, but is not limited to, cytosine, guanine, adenine, thymine and uracil.

The isolated polynucleotides of the present invention may be formulated. The formulation may comprise a lipid which may include, but is not limited to, DLin-DMA, DLin-K-DMA, DLin-KC2-DMA, 98N, 12-5, C12-200, DLin-MC3-DMA, PLGA, PEG, PEG-DMG, PEGylated lipids and mixtures thereof.

The isolated polynucleotides of the present invention may be administered at a total daily dose of between 0.001 ug and 150 ug. The administration may be by injection, topical administration, ophthalmic administration and intranasal administration. The injection may include injections such as, but not limited to, intradermal, subcutaneous and intramuscular. The topical administration may be, but is not limited to, a cream, lotion, ointment, gel, spray, solution and the like. The topical administration may further include a penetration enhancer such as, but not limited to, surfactants, fatty acids, bile salts, chelating agents, non-chelating non-surfactants, polyoxyethylene-9-lauryl ether, polyoxyethylene-20-cetyl ether, fatty acids and/or salts in combination with bile acids and/or salts, sodium salt in combination with lauric acid, capric acid and UDCA, and the like.

The isolated polynucleotide formulation may further include a pharmaceutically acceptable excipient such as, but not limited to, a solvent, aqueous solvent, non-aqueous solvent, dispersion media, diluent, dispersion, suspension aid, surface active agent, isotonic agent, thickening or emulsifying agent, preservative, lipid, lipidoids liposome, lipid nanoparticle, core-shell nanoparticles, polymer, lipoplex, peptide, protein, cell, hyaluronidase, and mixtures thereof.

The details of various embodiments of the invention are set forth in the description below. Other features, objects, and advantages of the invention will be apparent from the description and the drawings, and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

DETAILED DESCRIPTION

Figure 1:
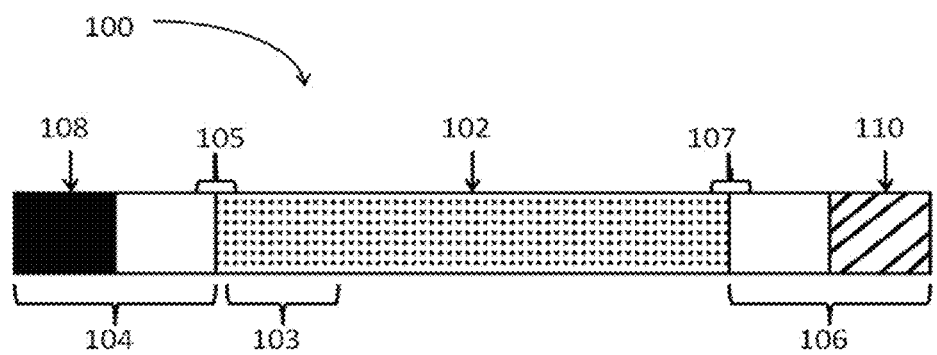
FIG. 1 is a schematic of an oncology related-primary construct of the present invention.

It is of great interest in the fields of therapeutics, diagnostics, reagents and for biological assays to be able to deliver a nucleic acid, e.g., a ribonucleic acid (RNA) inside a cell, whether in vitro, in vivo, in situ or ex vivo, such as to cause intracellular translation of the nucleic acid and production of an encoded polypeptide of interest. Of particular importance is the delivery and function of a non-integrative polynucleotide.

Described herein are compositions (including pharmaceutical compositions) and methods for the design, preparation, manufacture and/or formulation of polynucleotides encoding one or more oncology-related polypeptides of interest. Also provided are systems, processes, devices and kits for the selection, design and/or utilization of the polynucleotides encoding the oncology-related polypeptides of interest described herein.

According to the present invention, these oncology-related polynucleotides are preferably modified as to avoid the deficiencies of other polypeptide-encoding molecules of the art. Hence these polynucleotides are referred to as modified mRNA or mmRNA.

The use of modified polynucleotides in the fields of antibodies, viruses, veterinary applications and a variety of in vivo settings has been explored by the inventors and these studies are disclosed in for example, co-pending and co-owned U.S. provisional patent application Ser. Nos. 61/470,451 filed Mar. 31, 2011 teaching in vivo applications of mmRNA; 61/517,784 filed on Apr. 26, 2011 teaching engineered nucleic acids for the production of antibody polypeptides; 61/519,158 filed May 17, 2011 teaching veterinary applications of mmRNA technology; 61/533,537 filed on Sep. 12, 2011 teaching antimicrobial applications of mmRNA technology; 61/533,554 filed on Sep. 12, 2011 teaching viral applications of mmRNA technology, 61/542,533 filed on Oct. 3, 2011 teaching various chemical modifications for use in mmRNA technology; 61/570,690 filed on Dec. 14, 2011 teaching mobile devices for use in making or using mmRNA technology; 61/570,708 filed on Dec. 14, 2011 teaching the use of mmRNA in acute care situations; 61/576,651 filed on Dec. 16, 2011 teaching terminal modification architecture for mmRNA; 61/576,705 filed on Dec. 16, 2011 teaching delivery methods using lipidoids for mmRNA; 61/578,271 filed on Dec. 21, 2011 teaching methods to increase the viability of organs or tissues using mmRNA; 61/581,322 filed on Dec. 29, 2011 teaching mmRNA encoding cell penetrating peptides; 61/581,352 filed on Dec. 29, 2011 teaching the incorporation of cytotoxic nucleosides in mmRNA and 61/631,729 filed on Jan. 10, 2012 teaching methods of using mmRNA for crossing the blood brain barrier; all of which are herein incorporated by reference in their entirety.

Provided herein, in part, are oncology-related polynucleotides, oncology-related primary constructs and/or oncology-related mmRNA encoding oncology-related polypeptides of interest which have been designed to improve one or more of the stability and/or clearance in tissues, receptor uptake and/or kinetics, cellular access by the compositions, engagement with translational machinery, mRNA half-life, translation efficiency, immune evasion, protein production capacity, secretion efficiency (when applicable), accessibility to circulation, protein half-life and/or modulation of a cell's status, function and/or activity.

I. COMPOSITIONS OF THE INVENTION (MMRNA)

The present invention provides nucleic acid molecules, specifically oncology-related polynucleotides, oncology-related primary constructs and/or oncology-related mmRNA which encode one or more oncology-related polypeptides of interest. The term "nucleic acid," in its broadest sense, includes any compound and/or substance that comprise a polymer of nucleotides. These polymers are often referred to as polynucleotides. Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In preferred embodiments, the nucleic acid molecule is a messenger RNA (mRNA). As used herein, the term "messenger RNA" (mRNA) refers to any oncology-related polynucleotide which encodes an oncology-related polypeptide of interest and which is capable of being translated to produce the encoded oncology-related polypeptide of interest in vitro, in vivo, in situ or ex vivo.

Traditionally, the basic components of an mRNA molecule include at least a coding region, a 5'UTR, a 3'UTR, a 5' cap and a poly-A tail. Building on this wild type modular structure, the present invention expands the scope of functionality of traditional mRNA molecules by providing oncology-related polynucleotides or oncology-related primary RNA constructs which maintain a modular organization, but which comprise one or more structural and/or chemical modifications or alterations which impart useful properties to the polynucleotide including, in some embodiments, the lack of a substantial induction of the innate immune response of a cell into which the oncology-related polynucleotide is introduced. As such, modified mRNA molecules of the present invention are termed "mmRNA." As used herein, a "structural" feature or modification is one in which two or more linked nucleotides are inserted, deleted, duplicated, inverted or randomized in an oncology-related polynucleotide, oncology-related primary construct or oncology-related mmRNA without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCG". Here, the dinucleotide "CC" has been inserted, resulting in a structural modification to the oncology-related polynucleotide.

mmRNA Architecture

The mmRNA of the present invention are distinguished from wild type mRNA in their functional and/or structural design features which serve to, as evidenced herein, overcome existing problems of effective polypeptide production using nucleic acid-based therapeutics.

FIG. 1 shows a representative polynucleotide primary construct 100 of the present invention. As used herein, the term "primary construct" or "primary mRNA construct" refers to an oncology-related polynucleotide transcript which encodes one or more oncology-related polypeptides of interest and which retains sufficient structural and/or chemical features to allow the oncology-related polypeptide of interest encoded therein to be translated. Oncology-related primary constructs may be oncology-related polynucleotides of the invention. When structurally or chemically modified, the oncology-related primary construct may be referred to as an oncology-related mmRNA.

Returning to FIG. 1, the oncology-related primary construct 100 here contains a first region of linked nucleotides 102 that is flanked by a first flanking region 104 and a second flaking region 106. As used herein, the "first region" may be referred to as a "coding region" or "region encoding" or simply the "first region." This first region may include, but is not limited to, the encoded oncology-related polypeptide of interest. The oncology-related polypeptide of interest may comprise at its 5' terminus one or more signal sequences encoded by a signal sequence region 103. The flanking region 104 may comprise a region of linked nucleotides comprising one or more complete or incomplete 5' UTRs sequences. The flanking region 104 may also comprise a 5' terminal cap 108. The second flanking region 106 may comprise a region of linked nucleotides comprising one or more complete or incomplete 3' UTRs. The flanking region 106 may also comprise a 3' tailing sequence 110.

Bridging the 5' terminus of the first region 102 and the first flanking region 104 is a first operational region 105. Traditionally this operational region comprises a start codon. The operational region may alternatively comprise any translation initiation sequence or signal including a start codon.

Bridging the 3' terminus of the first region 102 and the second flanking region 106 is a second operational region 107. Traditionally this operational region comprises a stop codon. The operational region may alternatively comprise any translation initiation sequence or signal including a stop codon. According to the present invention, multiple serial stop codons may also be used. In one embodiment, the operation region of the present invention may comprise two stop codons. The first stop codon may be "TGA" and the second stop codon may be selected from the group consisting of "TAA," "TGA" and "TAG."

Generally, the shortest length of the first region of the oncology-related primary construct of the present invention can be the length of a nucleic acid sequence that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

Generally, the length of the first region encoding the oncology-related polypeptide of interest of the present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, the "first region" may be referred to as a "coding region" or "region encoding" or simply the "first region."

In some embodiments, the oncology-related polynucleotide, oncology-related primary construct, or oncology-related mmRNA includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, the first and second flanking regions may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

According to the present invention, the tailing sequence may range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA binding protein binding. In this embodiment, the polyA tail is long enough to bind at least 4 monomers of polyA binding protein. PolyA binding protein monomers bind to stretches of approximately 38 nucleotides. As such, it has been observed that polyA tails of about 80 nucleotides and 160 nucleotides are functional.

According to the present invention, the capping region may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

According to the present invention, the first and second operational regions may range from 3 to 40, e.g., 5-30, 10-20, 15, or at least 4, or 30 or fewer nucleotides in length and may comprise, in addition to a start and/or stop codon, one or more signal and/or restriction sequences.

Cyclic mmRNA

According to the present invention, an oncology-related primary construct or oncology-related mmRNA may be cyclized, or concatemerized, to generate a translation competent molecule to assist interactions between poly-A binding proteins and 5'-end binding proteins. The mechanism of cyclization or concatemerization may occur through at least 3 different routes: 1) chemical, 2) enzymatic, and 3) ribozyme catalyzed. The newly formed 5'-/3'-linkage may be intramolecular or intermolecular.

In the first route, the 5'-end and the 3'-end of the nucleic acid may contain chemically reactive groups that, when close together, form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphorodiester linkage. In an example reaction, 1 µg of a nucleic acid molecule is incubated at 37° C. for 1 hour with 1-10 units of T4 RNA ligase (New England Biolabs, Ipswich, Mass.) according to the manufacturer's protocol. The ligation reaction may occur in the presence of a split oligonucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

mmRNA Multimers

According to the present invention, multiple distinct oncology-related polynucleotides, oncology-related primary constructs or oncology-related mmRNA may be linked together through the 3'-end using nucleotides which are modified at the 3'-terminus. Chemical conjugation may be used to control the stoichiometry of delivery into cells. For example, the glyoxylate cycle enzymes, isocitrate lyase and malate synthase, may be supplied into HepG2 cells at a 1:1 ratio to alter cellular fatty acid metabolism. This ratio may be controlled by chemically linking oncology-related polynucleotides, oncology-related primary constructs or oncology-related mmRNA using a 3'-azido terminated nucleotide on one oncology-related polynucleotide, oncology-related primary construct or oncology-related mmRNA species and a C5-ethynyl or alkynyl-containing nucleotide on the opposite oncology-related polynucleotide, oncology-related primary construct or oncology-related mmRNA species. The modified nucleotide is added post-transcriptionally using terminal transferase (New England Biolabs, Ipswich, Mass.) according to the manufacturer's protocol. After the addition of the 3'-modified nucleotide, the two oncology-related polynucleotide, oncology-related primary construct or oncology-related mmRNA species may be combined in an aqueous solution, in the presence or absence of copper, to form a new covalent linkage via a click chemistry mechanism as described in the literature.

In another example, more than two oncology-related polynucleotides may be linked together using a functionalized linker molecule. For example, a functionalized saccharide molecule may be chemically modified to contain multiple chemical reactive groups ($SH-$, $NH_2-$, $N_3$, etc. ...) to react with the cognate moiety on a 3'-functionalized oncology-related mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated oncology-related polynucleotide, oncology-related primary construct or oncology-related mmRNA.

mmRNA Conjugates and Combinations

In order to further enhance oncology-related protein production, oncology-related primary constructs or oncology-related mmRNA of the present invention can be designed to be conjugated to other polynucleotides, oncology-related polypeptides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

Conjugation may result in increased stability and/or half life and may be particularly useful in targeting the oncology-related polynucleotides, oncology-related primary constructs or oncology-related mmRNA to specific sites in the cell, tissue or organism.

According to the present invention, the oncology-related mmRNA or oncology-related primary constructs may be administered with, or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

Bifunctional mmRNA

In one embodiment of the invention are bifunctional oncology-related polynucleotides (e.g., bifunctional oncology-related primary constructs or oncology-related bifunctional mmRNA). As the name implies, bifunctional oncology-related polynucleotides are those having or capable of at least two functions. These molecules may also by convention be referred to as multi-functional.

The multiple functionalities of bifunctional oncology-related polynucleotides may be encoded by the RNA (the function may not manifest until the encoded product is translated) or may be a property of the polynucleotide itself. It may be structural or chemical. Bifunctional modified oncology-related polynucleotides may comprise a function that is covalently or electrostatically associated with the polynucleotides. Further, the two functions may be provided in the context of a complex of a mmRNA and another molecule.

Bifunctional oncology-related polynucleotides may encode oncology-related peptides which are anti-proliferative. These peptides may be linear, cyclic, constrained or random coil. They may function as aptamers, signaling molecules, ligands or mimics or mimetics thereof. Anti-proliferative peptides may, as translated, be from 3 to 50 amino acids in length. They may be 5-40, 10-30, or approximately 15 amino acids long. They may be single chain, multichain or branched and may form complexes, aggregates or any multi-unit structure once translated.

Noncoding Oncology-Related Polynucleotides and Primary Constructs

As described herein, provided are oncology-related polynucleotides and oncology-related primary constructs having sequences that are partially or substantially not translatable, e.g., having a noncoding region. Such noncoding region may be the "first region" of the oncology-related primary construct. Alternatively, the noncoding region may be a region other than the first region. Such molecules are generally not translated, but can exert an effect on protein production by one or more of binding to and sequestering one or more translational machinery components such as a ribosomal protein or a transfer RNA (tRNA), thereby effectively reducing protein expression in the cell or modulating one or more pathways or cascades in a cell which in turn alters protein levels. The oncology-related polynucleotide and/or oncology-related primary construct may contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA).

Oncology-Related Polypeptides of Interest

According to the present invention, the oncology-related primary construct is designed to encode one or more oncology-related polypeptides of interest or fragments thereof. An oncology-related polypeptide of interest may include, but is not limited to, whole polypeptides, a plurality of polypeptides or fragments of polypeptides, which independently may be encoded by one or more nucleic acids, a plurality of nucleic acids, fragments of nucleic acids or variants of any of the aforementioned. As used herein, the term "oncology-related polypeptides of interest" refers to any polypeptide which is selected to be encoded in the oncology-related primary construct of the present invention. As used herein, "polypeptide" means a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides such as antibodies or insulin and may be associated or linked. Most commonly disulfide linkages are found in multichain polypeptides. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to polypeptide sequences means the corresponding sequence of other species having substantial identity to a second sequence of a second species.

"Analogs" is meant to include polypeptide variants which differ by one or more amino acid alterations, e.g., substitutions, additions or deletions of amino acid residues that still maintain one or more of the properties of the parent or starting polypeptide.

The present invention contemplates several types of compositions which are polypeptide based including variants and derivatives. These include substitutional, insertional, deletion and covalent variants and derivatives. The term "derivative" is used synonymously with the term "variant" but generally refers to a molecule that has been modified and/or changed in any way relative to a reference molecule or starting molecule.

As such, mmRNA encoding oncology-related polypeptides containing substitutions, insertions and/or additions, deletions and covalent modifications with respect to reference sequences, in particular the oncology-related polypeptide sequences disclosed herein, are included within the scope of this invention. For example, sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to polypeptides are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to polypeptides are those with one or more amino acids in the native or starting amino acid sequence removed. Ordinarily, deletional variants will have one or more amino acids deleted in a particular region of the molecule.

"Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed oncology-related polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the oncology-related polypeptides produced in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to polypeptides are defined as distinct amino acid sequence-based components of a molecule. Features of the polypeptides encoded by the mmRNA of the present invention include surface manifestations, local conformational shape, folds, loops, half-loops, domains, half-domains, sites, termini or any combination thereof.

As used herein when referring to polypeptides the term "surface manifestation" refers to a polypeptide based component of a protein appearing on an outermost surface.

As used herein when referring to polypeptides the term "local conformational shape" means a polypeptide based structural manifestation of a protein which is located within a definable space of the protein.

As used herein when referring to polypeptides the term "fold" refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to polypeptides the term "loop" refers to a structural feature of a polypeptide which may serve to reverse the direction of the backbone of a peptide or polypeptide. Where the loop is found in a polypeptide and only alters the direction of the backbone, it may comprise four or more amino acid residues. Oliva et al. have identified at least 5 classes of protein loops (J. Mol Biol 266 (4): 814-830; 1997). Loops may be open or closed. Closed loops or "cyclic" loops may comprise 2, 3, 4, 5, 6, 7, 8, 9, 10 or more amino acids between the bridging moieties. Such bridging moieties may comprise a cysteine-cysteine bridge (Cys-Cys) typical in polypeptides having disulfide bridges or alternatively bridging moieties may be non-protein based such as the dibromozylyl agents used herein.

As used herein when referring to polypeptides the term "half-loop" refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the term "half-domain" means a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that subdomains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to polypeptides the terms "site" as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein the terms "termini" or "terminus" when referring to polypeptides refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a desired component of a polypeptide to be encoded by the oncology-related primary construct or oncology-related mmRNA of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as, but not limited to, site directed mutagenesis. The resulting modified molecules may then be tested for activity using in vitro or in vivo assays such as those described herein or any other suitable screening assay known in the art.

According to the present invention, the oncology-related polypeptides may comprise a consensus sequence which is discovered through rounds of experimentation. As used herein a "consensus" sequence is a single sequence which represents a collective population of sequences allowing for variability at one or more sites.

As recognized by those skilled in the art, protein fragments, functional protein domains, and homologous proteins are also considered to be within the scope of oncology-related polypeptides of interest of this invention. For example, provided herein is any protein fragment (meaning an oncology-related polypeptide sequence at least one amino acid residue shorter than a reference oncology-related polypeptide sequence but otherwise identical) of a reference oncology-related protein 10, 20, 30, 40, 50, 60, 70, 80, 90, 100 or greater than 100 amino acids in length. In another example, any oncology-related protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a polypeptide to be utilized in accordance with the invention includes 2, 3, 4, 5, 6, 7, 8, 9, 10, or more mutations as shown in any of the sequences provided or referenced herein.

Encoded Oncology-Related Polypeptides

The oncology-related primary constructs or oncology-related mmRNA of the present invention may be designed to encode oncology-related polypeptides of interest such as oncology-related peptides and proteins.

In one embodiment oncology-related primary constructs or oncology-related mmRNA of the present invention may encode variant polypeptides which have a certain identity with a reference oncology-related polypeptide sequence. As used herein, a "reference oncology-related polypeptide sequence" refers to a starting oncology-related polypeptide sequence. Reference sequences may be wild type sequences or any sequence to which reference is made in the design of another sequence. A "reference polypeptide sequence" may, e.g., be any one of SEQ ID NOs: 4704-9203 as disclosed herein, e.g., any of SEQ ID NOs 4704, 4705, 4706, 4707, 4708, 4709, 4710, 4711, 4712, 4713, 4714, 4715, 4716, 4717, 4718, 4719, 4720, 4721, 4722, 4723, 4724, 4725, 4726, 4727, 4728, 4729, 4730, 4731, 4732, 4733, 4734, 4735, 4736, 4737, 4738, 4739, 4740, 4741, 4742, 4743, 4744, 4745, 4746, 4747, 4748, 4749, 4750, 4751, 4752, 4753, 4754, 4755, 4756, 4757, 4758, 4759, 4760, 4761, 4762, 4763, 4764, 4765, 4766, 4767, 4768, 4769, 4770, 4771, 4772, 4773, 4774, 4775, 4776, 4777, 4778, 4779, 4780, 4781, 4782, 4783, 4784, 4785, 4786, 4787, 4788, 4789, 4790, 4791, 4792, 4793, 4794, 4795, 4796, 4797, 4798, 4799, 4800, 4801, 4802, 4803, 4804, 4805, 4806, 4807, 4808, 4809, 4810, 4811, 4812, 4813, 4814, 4815, 4816, 4817, 4818, 4819, 4820, 4821, 4822, 4823, 4824, 4825, 4826, 4827, 4828, 4829, 4830, 4831, 4832, 4833, 4834, 4835, 4836, 4837, 4838, 4839, 4840, 4841, 4842, 4843, 4844, 4845, 4846, 4847, 4848, 4849, 4850, 4851, 4852, 4853, 4854, 4855, 4856, 4857, 4858, 4859, 4860, 4861, 4862, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4895, 4896, 4897, 4898, 4899, 4900, 4901, 4902, 4903, 4904, 4905, 4906, 4907, 4908, 4909, 4910, 4911, 4912, 4913, 4914, 4915, 4916, 4917, 4918, 4919, 4920, 4921, 4922, 4923, 4924, 4925, 4926, 4927, 4928, 4929, 4930, 4931, 4932, 4933, 4934, 4935, 4936, 4937, 4938, 4939, 4940, 4941, 4942, 4943, 4944, 4945, 4946, 4947, 4948, 4949, 4950, 4951, 4952, 4953, 4954, 4955, 4956, 4957, 4958, 4959, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5003, 5004, 5005, 5006, 5007, 5008, 5009, 5010, 5011, 5012, 5013, 5014, 5015, 5016, 5017, 5018, 5019, 5020, 5021, 5022, 5023, 5024, 5025, 5026, 5027, 5028, 5029, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5080, 5081, 5082, 5083, 5084, 5085, 5086, 5087, 5088, 5089, 5090, 5091, 5092, 5093, 5094, 5095, 5096, 5097, 5098, 5099, 5100, 5101, 5102, 5103, 5104, 5105, 5106, 5107, 5108, 5109, 5110, 5111, 5112, 5113, 5114, 5115, 5116, 5117, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5142, 5143, 5144, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5179, 5180, 5181, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5224, 5225, 5226, 5227, 5228, 5229, 5230, 5231, 5232, 5233, 5234, 5235, 5236, 5237, 5238, 5239, 5240, 5241, 5242, 5243, 5244, 5245, 5246, 5247, 5248, 5249, 5250, 5251, 5252, 5253, 5254, 5255, 5256, 5257, 5258, 5259, 5260, 5261, 5262, 5263, 5264, 5265, 5266, 5267, 5268, 5269, 5270, 5271, 5272, 5273, 5274, 5275, 5276, 5277, 5278, 5279, 5280, 5281, 5282, 5283, 5284, 5285, 5286, 5287, 5288, 5289, 5290, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5403, 5404, 5405, 5406, 5407, 5408, 5409, 5410, 5411, 5412, 5413, 5414, 5415, 5416, 5417, 5418, 5419, 5420, 5421, 5422, 5423, 5424, 5425, 5426, 5427, 5428, 5429, 5430, 5431, 5432, 5433, 5434, 5435, 5436, 5437, 5438, 5439, 5440, 5441, 5442, 5443, 5444, 5445, 5446, 5447, 5448, 5449, 5450, 5451, 5452, 5453, 5454, 5455, 5456, 5457, 5458, 5459, 5460, 5461, 5462, 5463, 5464, 5465, 5466, 5467, 5468, 5469, 5470, 5471, 5472, 5473, 5474, 5475, 5476, 5477, 5478, 5479, 5480, 5481, 5482, 5483, 5484, 5485, 5486, 5487, 5488, 5489, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5537, 5538, 5539, 5540, 5541, 5542, 5543, 5544, 5545, 5546, 5547, 5548, 5549, 5550, 5551, 5552, 5553, 5554, 5555, 5556, 5557, 5558, 5559, 5560, 5561, 5562, 5563, 5564, 5565, 5566, 5567, 5568, 5569, 5570, 5571, 5572, 5573, 5574, 5575, 5576, 5577, 5578, 5579, 5580, 5581, 5582, 5583, 5584, 5585, 5586, 5587, 5588, 5589, 5590, 5591, 5592, 5593, 5594, 5595, 5596, 5597, 5598, 5599, 5600, 5601, 5602, 5603, 5604, 5605, 5606, 5607, 5608, 5609, 5610, 5611, 5612, 5613, 5614, 5615, 5616, 5617, 5618, 5619, 5620, 5621, 5622, 5623, 5624, 5625, 5626, 5627, 5628, 5629, 5630, 5631, 5632, 5633, 5634, 5635, 5636, 5637, 5638, 5639, 5640, 5641, 5642, 5643, 5644, 5645, 5646, 5647, 5648, 5649, 5650, 5651, 5652, 5653, 5654, 5655, 5656, 5657, 5658, 5659, 5660, 5661, 5662, 5663, 5664, 5665, 5666, 5667, 5668, 5669, 5670, 5671, 5672, 5673, 5674, 5675, 5676, 5677, 5678, 5679, 5680, 5681, 5682, 5683, 5684, 5685, 5686, 5687, 5688, 5689, 5690, 5691, 5692, 5693, 5694, 5695, 5696, 5697, 5698, 5699, 5700, 5701, 5702, 5703, 5704, 5705, 5706, 5707, 5708, 5709, 5710, 5711, 5712, 5713, 5714, 5715, 5716, 5717, 5718, 5719, 5720, 5721, 5722, 5723, 5724, 5725, 5726, 5727, 5728, 5729, 5730, 5731, 5732, 5733, 5734, 5735, 5736, 5737, 5738, 5739, 5740, 5741, 5742, 5743, 5744, 5745, 5746, 5747, 5748, 5749, 5750, 5751, 5752, 5753, 5754, 5755, 5756, 5757, 5758, 5759, 5760, 5761, 5762, 5763, 5764, 5765, 5766, 5767, 5768, 5769, 5770, 5771, 5772, 5773, 5774, 5775, 5776, 5777, 5778, 5779, 5780, 5781, 5782, 5783, 5784, 5785, 5786, 5787, 5788, 5789, 5790, 5791, 5792, 5793, 5794, 5795, 5796, 5797, 5798, 5799, 5800, 5801, 5802, 5803, 5804, 5805, 5806, 5807, 5808, 5809, 5810, 5811, 5812, 5813, 5814, 5815, 5816, 5817, 5818, 5819, 5820, 5821, 5822, 5823, 5824, 5825, 5826, 5827, 5828, 5829, 5830, 5831, 5832, 5833, 5834, 5835, 5836, 5837, 5838, 5839, 5840, 5841, 5842, 5843, 5844, 5845, 5846, 5847, 5848, 5849, 5850, 5851, 5852, 5853, 5854, 5855, 5856, 5857, 5858, 5859, 5860, 5861, 5862, 5863, 5864, 5865, 5866, 5867, 5868, 5869, 5870, 5871, 5872, 5873, 5874, 5875, 5876, 5877, 5878, 5879, 5880, 5881, 5882, 5883, 5884, 5885, 5886, 5887, 5888, 5889, 5890, 5891, 5892, 5893, 5894, 5895, 5896, 5897, 5898, 5899, 5900, 5901, 5902, 5903, 5904, 5905, 5906, 5907, 5908, 5909, 5910, 5911, 5912, 5913, 5914, 5915, 5916, 5917, 5918, 5919, 5920, 5921, 5922, 5923, 5924, 5925, 5926, 5927, 5928, 5929, 5930, 5931, 5932, 5933, 5934, 5935, 5936, 5937, 5938, 5939, 5940, 5941, 5942, 5943, 5944, 5945, 5946, 5947, 5948, 5949, 5950, 5951, 5952, 5953, 5954, 5955, 5956, 5957, 5958, 5959, 5960, 5961, 5962, 5963, 5964, 5965, 5966, 5967, 5968, 5969, 5970, 5971, 5972, 5973, 5974, 5975, 5976, 5977, 5978, 5979, 5980, 5981, 5982, 5983, 5984, 5985, 5986, 5987, 5988, 5989, 5990, 5991, 5992, 5993, 5994, 5995, 5996, 5997, 5998, 5999, 6000, 6001, 6002, 6003, 6004, 6005, 6006, 6007, 6008, 6009, 6010, 6011, 6012, 6013, 6014, 6015, 6016, 6017, 6018, 6019, 6020, 6021, 6022, 6023, 6024, 6025, 6026, 6027, 6028, 6029, 6030, 6031, 6032, 6033, 6034, 6035, 6036, 6037, 6038, 6039, 6040, 6041, 6042, 6043, 6044, 6045, 6046, 6047, 6048, 6049, 6050, 6051, 6052, 6053, 6054, 6055, 6056, 6057, 6058, 6059, 6060, 6061, 6062, 6063, 6064, 6065, 6066, 6067, 6068, 6069, 6070, 6071, 6072, 6073, 6074, 6075, 6076, 6077, 6078, 6079, 6080, 6081, 6082, 6083, 6084, 6085, 6086, 6087, 6088, 6089, 6090, 6091, 6092, 6093, 6094, 6095, 6096, 6097, 6098, 6099, 6100, 6101, 6102, 6103, 6104, 6105, 6106, 6107, 6108, 6109, 6110, 6111, 6112, 6113, 6114, 6115, 6116, 6117, 6118, 6119, 6120, 6121, 6122, 6123, 6124, 6125, 6126, 6127, 6128, 6129, 6130, 6131, 6132, 6133, 6134, 6135, 6136, 6137, 6138, 6139, 6140, 6141, 6142, 6143, 6144, 6145, 6146, 6147, 6148, 6149, 6150, 6151, 6152, 6153, 6154, 6155, 6156, 6157, 6158, 6159, 6160, 6161, 6162, 6163, 6164, 6165, 6166, 6167, 6168, 6169, 6170, 6171, 6172, 6173, 6174, 6175, 6176, 6177, 6178, 6179, 6180, 6181, 6182, 6183, 6184, 6185, 6186, 6187, 6188, 6189, 6190, 6191, 6192, 6193, 6194, 6195, 6196, 6197, 6198, 6199, 6200, 6201, 6202, 6203, 6204, 6205, 6206, 6207, 6208, 6209, 6210, 6211, 6212, 6213, 6214, 6215, 6216, 6217, 6218, 6219, 6220, 6221, 6222, 6223, 6224, 6225, 6226, 6227, 6228, 6229, 6230, 6231, 6232, 6233, 6234, 6235, 6236, 6237, 6238, 6239, 6240, 6241, 6242, 6243, 6244, 6245, 6246, 6247, 6248, 6249, 6250, 6251, 6252, 6253, 6254, 6255, 6256, 6257, 6258, 6259, 6260, 6261, 6262, 6263, 6264, 6265, 6266, 6267, 6268, 6269, 6270, 6271, 6272, 6273, 6274, 6275, 6276, 6277, 6278, 6279, 6280, 6281, 6282, 6283, 6284, 6285, 6286, 6287, 6288, 6289, 6290, 6291, 6292, 6293, 6294, 6295, 6296, 6297, 6298, 6299, 6300, 6301, 6302, 6303, 6304, 6305, 6306, 6307, 6308, 6309, 6310, 6311, 6312, 6313, 6314, 6315, 6316, 6317, 6318, 6319, 6320, 6321, 6322, 6323, 6324, 6325, 6326, 6327, 6328, 6329, 6330, 6331, 6332, 6333, 6334, 6335, 6336, 6337, 6338, 6339, 6340, 6341, 6342, 6343, 6344, 6345, 6346, 6347, 6348, 6349, 6350, 6351, 6352, 6353, 6354, 6355, 6356, 6357, 6358, 6359, 6360, 6361, 6362, 6363, 6364, 6365, 6366, 6367, 6368, 6369, 6370, 6371, 6372, 6373, 6374, 6375, 6376, 6377, 6378, 6379, 6380, 6381, 6382, 6383, 6384, 6385, 6386, 6387, 6388, 6389, 6390, 6391, 6392, 6393, 6394, 6395, 6396, 6397, 6398, 6399, 6400, 6401, 6402, 6403, 6404, 6405, 6406, 6407, 6408, 6409, 6410, 6411, 6412, 6413, 6414, 6415, 6416, 6417, 6418, 6419, 6420, 6421, 6422, 6423, 6424, 6425, 6426, 6427, 6428, 6429, 6430, 6431, 6432, 6433, 6434, 6435, 6436, 6437, 6438, 6439, 6440, 6441, 6442, 6443, 6444, 6445, 6446, 6447, 6448, 6449, 6450, 6451, 6452, 6453, 6454, 6455, 6456, 6457, 6458, 6459, 6460, 6461, 6462, 6463, 6464, 6465, 6466, 6467, 6468, 6469, 6470, 6471, 6472, 6473, 6474, 6475, 6476, 6477, 6478, 6479, 6480, 6481, 6482, 6483, 6484, 6485, 6486, 6487, 6488, 6489, 6490, 6491, 6492, 6493, 6494, 6495, 6496, 6497, 6498, 6499, 6500, 6501, 6502, 6503, 6504, 6505, 6506, 6507, 6508, 6509, 6510, 6511, 6512, 6513, 6514, 6515, 6516, 6517, 6518, 6519, 6520, 6521, 6522, 6523, 6524, 6525, 6526, 6527, 6528, 6529, 6530, 6531, 6532, 6533, 6534, 6535, 6536, 6537, 6538, 6539, 6540, 6541, 6542, 6543, 6544, 6545, 6546, 6547, 6548, 6549, 6550, 6551, 6552, 6553, 6554, 6555, 6556, 6557, 6558, 6559, 6560, 6561, 6562, 6563, 6564, 6565, 6566, 6567, 6568, 6569, 6570, 6571, 6572, 6573, 6574, 6575, 6576, 6577, 6578, 6579, 6580, 6581, 6582, 6583, 6584, 6585, 6586, 6587, 6588, 6589, 6590, 6591, 6592, 6593, 6594, 6595, 6596, 6597, 6598, 6599, 6600, 6601, 6602, 6603, 6604, 6605, 6606, 6607, 6608, 6609, 6610, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6635, 6636, 6637, 6638, 6639, 6640, 6641, 6642, 6643, 6644, 6645, 6646, 6647, 6648, 6649, 6650, 6651, 6652, 6653, 6654, 6655, 6656, 6657, 6658, 6659, 6660, 6661, 6662, 6663, 6664, 6665, 6666, 6667, 6668, 6669, 6670, 6671, 6672, 6673, 6674, 6675, 6676, 6677, 6678, 6679, 6680, 6681, 6682, 6683, 6684, 6685, 6686, 6687, 6688, 6689, 6690, 6691, 6692, 6693, 6694, 6695, 6696, 6697, 6698, 6699, 6700, 6701, 6702, 6703, 6704, 6705, 6706, 6707, 6708, 6709, 6710, 6711, 6712, 6713, 6714, 6715, 6716, 6717, 6718, 6719, 6720, 6721, 6722, 6723, 6724, 6725, 6726, 6727, 6728, 6729, 6730, 6731, 6732, 6733, 6734, 6735, 6736, 6737, 6738, 6739, 6740, 6741, 6742, 6743, 6744, 6745, 6746, 6747, 6748, 6749, 6750, 6751, 6752, 6753, 6754, 6755, 6756, 6757, 6758, 6759, 6760, 6761, 6762, 6763, 6764, 6765, 6766, 6767, 6768, 6769, 6770, 6771, 6772, 6773, 6774, 6775, 6776, 6777, 6778, 6779, 6780, 6781, 6782, 6783, 6784, 6785, 6786, 6787, 6788, 6789, 6790, 6791, 6792, 6793, 6794, 6795, 6796, 6797, 6798, 6799, 6800, 6801, 6802, 6803, 6804, 6805, 6806, 6807, 6808, 6809, 6810, 6811, 6812, 6813, 6814, 6815, 6816, 6817, 6818, 6819, 6820, 6821, 6822, 6823, 6824, 6825, 6826, 6827, 6828, 6829, 6830, 6831, 6832, 6833, 6834, 6835, 6836, 6837, 6838, 6839, 6840, 6841, 6842, 6843, 6844, 6845, 6846, 6847, 6848, 6849, 6850, 6851, 6852, 6853, 6854, 6855, 6856, 6857, 6858, 6859, 6860, 6861, 6862, 6863, 6864, 6865, 6866, 6867, 6868, 6869, 6870, 6871, 6872, 6873, 6874, 6875, 6876, 6877, 6878, 6879, 6880, 6881, 6882, 6883, 6884, 6885, 6886, 6887, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6937, 6938, 6939, 6940, 6941, 6942, 6943, 6944, 6945, 6946, 6947, 6948, 6949, 6950, 6951, 6952, 6953, 6954, 6955, 6956, 6957, 6958, 6959, 6960, 6961, 6962, 6963, 6964, 6965, 6966, 6967, 6968, 6969, 6970, 6971, 6972, 6973, 6974, 6975, 6976, 6977, 6978, 6979, 6980, 6981, 6982, 6983, 6984, 6985, 6986, 6987, 6988, 6989, 6990, 6991, 6992, 6993, 6994, 6995, 6996, 6997, 6998, 6999, 7000, 7001, 7002, 7003, 7004, 7005, 7006, 7007, 7008, 7009, 7010, 7011, 7012, 7013, 7014, 7015, 7016, 7017, 7018, 7019, 7020, 7021, 7022, 7023, 7024, 7025, 7026, 7027, 7028, 7029, 7030, 7031, 7032, 7033, 7034, 7035, 7036, 7037, 7038, 7039, 7040, 7041, 7042, 7043, 7044, 7045, 7046, 7047, 7048, 7049, 7050, 7051, 7052, 7053, 7054, 7055, 7056, 7057, 7058, 7059, 7060, 7061, 7062, 7063, 7064, 7065, 7066, 7067, 7068, 7069, 7070, 7071, 7072, 7073, 7074, 7075, 7076, 7077, 7078, 7079, 7080, 7081, 7082, 7083, 7084, 7085, 7086, 7087, 7088, 7089, 7090, 7091, 7092, 7093, 7094, 7095, 7096, 7097, 7098, 7099, 7100, 7101, 7102, 7103, 7104, 7105, 7106, 7107, 7108, 7109, 7110, 7111, 7112, 7113, 7114, 7115, 7116, 7117, 7118, 7119, 7120, 7121, 7122, 7123, 7124, 7125, 7126, 7127, 7128, 7129, 7130, 7131, 7132, 7133, 7134, 7135, 7136, 7137, 7138, 7139, 7140, 7141, 7142, 7143, 7144, 7145, 7146, 7147, 7148, 7149, 7150, 7151, 7152, 7153, 7154, 7155, 7156, 7157, 7158, 7159, 7160, 7161, 7162, 7163, 7164, 7165, 7166, 7167, 7168, 7169, 7170, 7171, 7172, 7173, 7174, 7175, 7176, 7177, 7178, 7179, 7180, 7181, 7182, 7183, 7184, 7185, 7186, 7187, 7188, 7189, 7190, 7191, 7192, 7193, 7194, 7195, 7196, 7197, 7198, 7199, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7242, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7272, 7273, 7274, 7275, 7276, 7277, 7278, 7279, 7280, 7281, 7282, 7283, 7284, 7285, 7286, 7287, 7288, 7289, 7290, 7291, 7292, 7293, 7294, 7295, 7296, 7297, 7298, 7299, 7300, 7301, 7302, 7303, 7304, 7305, 7306, 7307, 7308, 7309, 7310, 7311, 7312, 7313, 7314, 7315, 7316, 7317, 7318, 7319, 7320, 7321, 7322, 7323, 7324, 7325, 7326, 7327, 7328, 7329, 7330, 7331, 7332, 7333, 7334, 7335, 7336, 7337, 7338, 7339, 7340, 7341, 7342, 7343, 7344, 7345, 7346, 7347, 7348, 7349, 7350, 7351, 7352, 7353, 7354, 7355, 7356, 7357, 7358, 7359, 7360, 7361, 7362, 7363, 7364, 7365, 7366, 7367, 7368, 7369, 7370, 7371, 7372, 7373, 7374, 7375, 7376, 7377, 7378, 7379, 7380, 7381, 7382, 7383, 7384, 7385, 7386, 7387, 7388, 7389, 7390, 7391, 7392, 7393, 7394, 7395, 7396, 7397, 7398, 7399, 7400, 7401, 7402, 7403, 7404, 7405, 7406, 7407, 7408, 7409, 7410, 7411, 7412, 7413, 7414, 7415, 7416, 7417, 7418, 7419, 7420, 7421, 7422, 7423, 7424, 7425, 7426, 7427, 7428, 7429, 7430, 7431, 7432, 7433, 7434, 7435, 7436, 7437, 7438, 7439, 7440, 7441, 7442, 7443, 7444, 7445, 7446, 7447,
7448, 7449, 7450, 7451, 7452, 7453, 7454, 7455, 7456, 7457,
7458, 7459, 7460, 7461, 7462, 7463, 7464, 7465, 7466, 7467,
7468, 7469, 7470, 7471, 7472, 7473, 7474, 7475, 7476, 7477,
7478, 7479, 7480, 7481, 7482, 7483, 7484, 7485, 7486, 7487,
7488, 7489, 7490, 7491, 7492, 7493, 7494, 7495, 7496, 7497,
7498, 7499, 7500, 7501, 7502, 7503, 7504, 7505, 7506, 7507,
7508, 7509, 7510, 7511, 7512, 7513, 7514, 7515, 7516, 7517,
7518, 7519, 7520, 7521, 7522, 7523, 7524, 7525, 7526, 7527,
7528, 7529, 7530, 7531, 7532, 7533, 7534, 7535, 7536, 7537,
7538, 7539, 7540, 7541, 7542, 7543, 7544, 7545, 7546, 7547,
7548, 7549, 7550, 7551, 7552, 7553, 7554, 7555, 7556, 7557,
7558, 7559, 7560, 7561, 7562, 7563, 7564, 7565, 7566, 7567,
7568, 7569, 7570, 7571, 7572, 7573, 7574, 7575, 7576, 7577,
7578, 7579, 7580, 7581, 7582, 7583, 7584, 7585, 7586, 7587,
7588, 7589, 7590, 7591, 7592, 7593, 7594, 7595, 7596, 7597,
7598, 7599, 7600, 7601, 7602, 7603, 7604, 7605, 7606, 7607,
7608, 7609, 7610, 7611, 7612, 7613, 7614, 7615, 7616, 7617,
7618, 7619, 7620, 7621, 7622, 7623, 7624, 7625, 7626, 7627,
7628, 7629, 7630, 7631, 7632, 7633, 7634, 7635, 7636, 7637,
7638, 7639, 7640, 7641, 7642, 7643, 7644, 7645, 7646, 7647,
7648, 7649, 7650, 7651, 7652, 7653, 7654, 7655, 7656, 7657,
7658, 7659, 7660, 7661, 7662, 7663, 7664, 7665, 7666, 7667,
7668, 7669, 7670, 7671, 7672, 7673, 7674, 7675, 7676, 7677,
7678, 7679, 7680, 7681, 7682, 7683, 7684, 7685, 7686, 7687,
7688, 7689, 7690, 7691, 7692, 7693, 7694, 7695, 7696, 7697,
7698, 7699, 7700, 7701, 7702, 7703, 7704, 7705, 7706, 7707,
7708, 7709, 7710, 7711, 7712, 7713, 7714, 7715, 7716, 7717,
7718, 7719, 7720, 7721, 7722, 7723, 7724, 7725, 7726, 7727,
7728, 7729, 7730, 7731, 7732, 7733, 7734, 7735, 7736, 7737,
7738, 7739, 7740, 7741, 7742, 7743, 7744, 7745, 7746, 7747,
7748, 7749, 7750, 7751, 7752, 7753, 7754, 7755, 7756, 7757,
7758, 7759, 7760, 7761, 7762, 7763, 7764, 7765, 7766, 7767,
7768, 7769, 7770, 7771, 7772, 7773, 7774, 7775, 7776, 7777,
7778, 7779, 7780, 7781, 7782, 7783, 7784, 7785, 7786, 7787,
7788, 7789, 7790, 7791, 7792, 7793, 7794, 7795, 7796, 7797,
7798, 7799, 7800, 7801, 7802, 7803, 7804, 7805, 7806, 7807,
7808, 7809, 7810, 7811, 7812, 7813, 7814, 7815, 7816, 7817,
7818, 7819, 7820, 7821, 7822, 7823, 7824, 7825, 7826, 7827,
7828, 7829, 7830, 7831, 7832, 7833, 7834, 7835, 7836, 7837,
7838, 7839, 7840, 7841, 7842, 7843, 7844, 7845, 7846, 7847,
7848, 7849, 7850, 7851, 7852, 7853, 7854, 7855, 7856, 7857,
7858, 7859, 7860, 7861, 7862, 7863, 7864, 7865, 7866, 7867,
7868, 7869, 7870, 7871, 7872, 7873, 7874, 7875, 7876, 7877,
7878, 7879, 7880, 7881, 7882, 7883, 7884, 7885, 7886, 7887,
7888, 7889, 7890, 7891, 7892, 7893, 7894, 7895, 7896, 7897,
7898, 7899, 7900, 7901, 7902, 7903, 7904, 7905, 7906, 7907,
7908, 7909, 7910, 7911, 7912, 7913, 7914, 7915, 7916, 7917,
7918, 7919, 7920, 7921, 7922, 7923, 7924, 7925, 7926, 7927,
7928, 7929, 7930, 7931, 7932, 7933, 7934, 7935, 7936, 7937,
7938, 7939, 7940, 7941, 7942, 7943, 7944, 7945, 7946, 7947,
7948, 7949, 7950, 7951, 7952, 7953, 7954, 7955, 7956, 7957,
7958, 7959, 7960, 7961, 7962, 7963, 7964, 7965, 7966, 7967,
7968, 7969, 7970, 7971, 7972, 7973, 7974, 7975, 7976, 7977,
7978, 7979, 7980, 7981, 7982, 7983, 7984, 7985, 7986, 7987,
7988, 7989, 7990, 7991, 7992, 7993, 7994, 7995, 7996, 7997,
7998, 7999, 8000, 8001, 8002, 8003, 8004, 8005, 8006, 8007,
8008, 8009, 8010, 8011, 8012, 8013, 8014, 8015, 8016, 8017,
8018, 8019, 8020, 8021, 8022, 8023, 8024, 8025, 8026, 8027,
8028, 8029, 8030, 8031, 8032, 8033, 8034, 8035, 8036, 8037,
8038, 8039, 8040, 8041, 8042, 8043, 8044, 8045, 8046, 8047,
8048, 8049, 8050, 8051, 8052, 8053, 8054, 8055, 8056, 8057,
8058, 8059, 8060, 8061, 8062, 8063, 8064, 8065, 8066, 8067,
8068, 8069, 8070, 8071, 8072, 8073, 8074, 8075, 8076, 8077,
8078, 8079, 8080, 8081, 8082, 8083, 8084, 8085, 8086, 8087,
8088, 8089, 8090, 8091, 8092, 8093, 8094, 8095, 8096, 8097,
8098, 8099, 8100, 8101, 8102, 8103, 8104, 8105, 8106, 8107,
8108, 8109, 8110, 8111, 8112, 8113, 8114, 8115, 8116, 8117,
8118, 8119, 8120, 8121, 8122, 8123, 8124, 8125, 8126, 8127,
8128, 8129, 8130, 8131, 8132, 8133, 8134, 8135, 8136, 8137,
8138, 8139, 8140, 8141, 8142, 8143, 8144, 8145, 8146, 8147,
8148, 8149, 8150, 8151, 8152, 8153, 8154, 8155, 8156, 8157,
8158, 8159, 8160, 8161, 8162, 8163, 8164, 8165, 8166, 8167,
8168, 8169, 8170, 8171, 8172, 8173, 8174, 8175, 8176, 8177,
8178, 8179, 8180, 8181, 8182, 8183, 8184, 8185, 8186, 8187,
8188, 8189, 8190, 8191, 8192, 8193, 8194, 8195, 8196, 8197,
8198, 8199, 8200, 8201, 8202, 8203, 8204, 8205, 8206, 8207,
8208, 8209, 8210, 8211, 8212, 8213, 8214, 8215, 8216, 8217,
8218, 8219, 8220, 8221, 8222, 8223, 8224, 8225, 8226, 8227,
8228, 8229, 8230, 8231, 8232, 8233, 8234, 8235, 8236, 8237,
8238, 8239, 8240, 8241, 8242, 8243, 8244, 8245, 8246, 8247,
8248, 8249, 8250, 8251, 8252, 8253, 8254, 8255, 8256, 8257,
8258, 8259, 8260, 8261, 8262, 8263, 8264, 8265, 8266, 8267,
8268, 8269, 8270, 8271, 8272, 8273, 8274, 8275, 8276, 8277,
8278, 8279, 8280, 8281, 8282, 8283, 8284, 8285, 8286, 8287,
8288, 8289, 8290, 8291, 8292, 8293, 8294, 8295, 8296, 8297,
8298, 8299, 8300, 8301, 8302, 8303, 8304, 8305, 8306, 8307,
8308, 8309, 8310, 8311, 8312, 8313, 8314, 8315, 8316, 8317,
8318, 8319, 8320, 8321, 8322, 8323, 8324, 8325, 8326, 8327,
8328, 8329, 8330, 8331, 8332, 8333, 8334, 8335, 8336, 8337,
8338, 8339, 8340, 8341, 8342, 8343, 8344, 8345, 8346, 8347,
8348, 8349, 8350, 8351, 8352, 8353, 8354, 8355, 8356, 8357,
8358, 8359, 8360, 8361, 8362, 8363, 8364, 8365, 8366, 8367,
8368, 8369, 8370, 8371, 8372, 8373, 8374, 8375, 8376, 8377,
8378, 8379, 8380, 8381, 8382, 8383, 8384, 8385, 8386, 8387,
8388, 8389, 8390, 8391, 8392, 8393, 8394, 8395, 8396, 8397,
8398, 8399, 8400, 8401, 8402, 8403, 8404, 8405, 8406, 8407,
8408, 8409, 8410, 8411, 8412, 8413, 8414, 8415, 8416, 8417,
8418, 8419, 8420, 8421, 8422, 8423, 8424, 8425, 8426, 8427,
8428, 8429, 8430, 8431, 8432, 8433, 8434, 8435, 8436, 8437,
8438, 8439, 8440, 8441, 8442, 8443, 8444, 8445, 8446, 8447,
8448, 8449, 8450, 8451, 8452, 8453, 8454, 8455, 8456, 8457,
8458, 8459, 8460, 8461, 8462, 8463, 8464, 8465, 8466, 8467,
8468, 8469, 8470, 8471, 8472, 8473, 8474, 8475, 8476, 8477,
8478, 8479, 8480, 8481, 8482, 8483, 8484, 8485, 8486, 8487,
8488, 8489, 8490, 8491, 8492, 8493, 8494, 8495, 8496, 8497,
8498, 8499, 8500, 8501, 8502, 8503, 8504, 8505, 8506, 8507,
8508, 8509, 8510, 8511, 8512, 8513, 8514, 8515, 8516, 8517,
8518, 8519, 8520, 8521, 8522, 8523, 8524, 8525, 8526, 8527,
8528, 8529, 8530, 8531, 8532, 8533, 8534, 8535, 8536, 8537,
8538, 8539, 8540, 8541, 8542, 8543, 8544, 8545, 8546, 8547,
8548, 8549, 8550, 8551, 8552, 8553, 8554, 8555, 8556, 8557,
8558, 8559, 8560, 8561, 8562, 8563, 8564, 8565, 8566, 8567,
8568, 8569, 8570, 8571, 8572, 8573, 8574, 8575, 8576, 8577,
8578, 8579, 8580, 8581, 8582, 8583, 8584, 8585, 8586, 8587,
8588, 8589, 8590, 8591, 8592, 8593, 8594, 8595, 8596, 8597,
8598, 8599, 8600, 8601, 8602, 8603, 8604, 8605, 8606, 8607,
8608, 8609, 8610, 8611, 8612, 8613, 8614, 8615, 8616, 8617,
8618, 8619, 8620, 8621, 8622, 8623, 8624, 8625, 8626, 8627,
8628, 8629, 8630, 8631, 8632, 8633, 8634, 8635, 8636, 8637,
8638, 8639, 8640, 8641, 8642, 8643, 8644, 8645, 8646, 8647,
8648, 8649, 8650, 8651, 8652, 8653, 8654, 8655, 8656, 8657,
8658, 8659, 8660, 8661, 8662, 8663, 8664, 8665, 8666, 8667,
8668, 8669, 8670, 8671, 8672, 8673, 8674, 8675, 8676, 8677,
8678, 8679, 8680, 8681, 8682, 8683, 8684, 8685, 8686, 8687,
8688, 8689, 8690, 8691, 8692, 8693, 8694, 8695, 8696, 8697,
8698, 8699, 8700, 8701, 8702, 8703, 8704, 8705, 8706, 8707,
8708, 8709, 8710, 8711, 8712, 8713, 8714, 8715, 8716, 8717,
8718, 8719, 8720, 8721, 8722, 8723, 8724, 8725, 8726, 8727,
8728, 8729, 8730, 8731, 8732, 8733, 8734, 8735, 8736, 8737,
8738, 8739, 8740, 8741, 8742, 8743, 8744, 8745, 8746, 8747,
8748, 8749, 8750, 8751, 8752, 8753, 8754, 8755, 8756, 8757,
8758, 8759, 8760, 8761, 8762, 8763, 8764, 8765, 8766, 8767,
8768, 8769, 8770, 8771, 8772, 8773, 8774, 8775, 8776, 8777, 8778, 8779, 8780, 8781, 8782, 8783, 8784, 8785, 8786, 8787, 8788, 8789, 8790, 8791, 8792, 8793, 8794, 8795, 8796, 8797, 8798, 8799, 8800, 8801, 8802, 8803, 8804, 8805, 8806, 8807, 8808, 8809, 8810, 8811, 8812, 8813, 8814, 8815, 8816, 8817, 8818, 8819, 8820, 8821, 8822, 8823, 8824, 8825, 8826, 8827, 8828, 8829, 8830, 8831, 8832, 8833, 8834, 8835, 8836, 8837, 8838, 8839, 8840, 8841, 8842, 8843, 8844, 8845, 8846, 8847, 8848, 8849, 8850, 8851, 8852, 8853, 8854, 8855, 8856, 8857, 8858, 8859, 8860, 8861, 8862, 8863, 8864, 8865, 8866, 8867, 8868, 8869, 8870, 8871, 8872, 8873, 8874, 8875, 8876, 8877, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8905, 8906, 8907, 8908, 8909, 8910, 8911, 8912, 8913, 8914, 8915, 8916, 8917, 8918, 8919, 8920, 8921, 8922, 8923, 8924, 8925, 8926, 8927, 8928, 8929, 8930, 8931, 8932, 8933, 8934, 8935, 8936, 8937, 8938, 8939, 8940, 8941, 8942, 8943, 8944, 8945, 8946, 8947, 8948, 8949, 8950, 8951, 8952, 8953, 8954, 8955, 8956, 8957, 8958, 8959, 8960, 8961, 8962, 8963, 8964, 8965, 8966, 8967, 8968, 8969, 8970, 8971, 8972, 8973, 8974, 8975, 8976, 8977, 8978, 8979, 8980, 8981, 8982, 8983, 8984, 8985, 8986, 8987, 8988, 8989, 8990, 8991, 8992, 8993, 8994, 8995, 8996, 8997, 8998, 8999, 9000, 9001, 9002, 9003, 9004, 9005, 9006, 9007, 9008, 9009, 9010, 9011, 9012, 9013, 9014, 9015, 9016, 9017, 9018, 9019, 9020, 9021, 9022, 9023, 9024, 9025, 9026, 9027, 9028, 9029, 9030, 9031, 9032, 9033, 9034, 9035, 9036, 9037, 9038, 9039, 9040, 9041, 9042, 9043, 9044, 9045, 9046, 9047, 9048, 9049, 9050, 9051, 9052, 9053, 9054, 9055, 9056, 9057, 9058, 9059, 9060, 9061, 9062, 9063, 9064, 9065, 9066, 9067, 9068, 9069, 9070, 9071, 9072, 9073, 9074, 9075, 9076, 9077, 9078, 9079, 9080, 9081, 9082, 9083, 9084, 9085, 9086, 9087, 9088, 9089, 9090, 9091, 9092, 9093, 9094, 9095, 9096, 9097, 9098, 9099, 9100, 9101, 9102, 9103, 9104, 9105, 9106, 9107, 9108, 9109, 9110, 9111, 9112, 9113, 9114, 9115, 9116, 9117, 9118, 9119, 9120, 9121, 9122, 9123, 9124, 9125, 9126, 9127, 9128, 9129, 9130, 9131, 9132, 9133, 9134, 9135, 9136, 9137, 9138, 9139, 9140, 9141, 9142, 9143, 9144, 9145, 9146, 9147, 9148, 9149, 9150, 9151, 9152, 9153, 9154, 9155, 9156, 9157, 9158, 9159, 9160, 9161, 9162, 9163, 9164, 9165, 9166, 9167, 9168, 9169, 9170, 9171, 9172, 9173, 9174, 9175, 9176, 9177, 9178, 9179, 9180, 9181, 9182, 9183, 9184, 9185, 9186, 9187, 9188, 9189, 9190, 9191, 9192, 9193, 9194, 9195, 9196, 9197, 9198, 9199, 9200, 9201, 9202, 9203.

The term "identity" as known in the art, refers to a relationship between the sequences of two or more peptides, as determined by comparing the sequences. In the art, identity also means the degree of sequence relatedness between peptides, as determined by the number of matches between strings of two or more amino acid residues. Identity measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the polypeptide variant may have the same or a similar activity as the reference oncology-related polypeptide. Alternatively, the variant may have an altered activity (e.g., increased or decreased) relative to a reference oncology-related polypeptide. Generally, variants of a particular oncology-related polynucleotide or oncology-related polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference oncology-related polynucleotide or oncology-related polypeptide as determined by sequence alignment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) Other tools are described herein, specifically in the definition of "identity."

Default parameters in the BLAST algorithm include, for example, an expect threshold of 10, Word size of 28, Match/Mismatch Scores 1, -2, Gap costs Linear. Any filter can be applied as well as a selection for species specific repeats, e.g., Homo sapiens.

In one embodiment, the oncology-related polynucleotides, oncology-related primary constructs and/or oncology-related mmRNA may be used to treat a disease, disorder and/or condition in a subject.

In one embodiment, the oncology-related polynucleotides, oncology-related primary constructs and/or oncology-related mmRNA may be used to reduce, eliminate or prevent tumor growth in a subject.

In one embodiment, the oncology-related polynucleotides, oncology-related primary constructs and/or oncology-related mmRNA may be used to recude and/or ameliorate at least one symptom of cancer in a subject. A symptom of cancer may include, but is not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness. Further, the oncology-related polynucleotides, oncology-related primary constructs and/or oncology-related mmRNA may reduce a side-effect associated with cancer such as, but not limited to, chemo brain, peripheral neuropathy, fatigue, depression, nausea, vomiting, pain, anemia, lymphedema, infections, sexual side effects, reduced fertility or infertility, ostomics, insomnia and hair loss.

Oncology-Related Proteins or Oncology-Related Peptides

The oncology-related primary constructs or oncology-related mmRNA disclosed herein, may encode one or more validated or "in testing" oncology-related proteins or oncology-related peptides.

According to the present invention, one or more oncology-related proteins or oncology-related peptides currently being marketed or in development may be encoded by the oncology-related polynucleotides, oncology-related primary constructs or oncology-related mmRNA of the present invention. While not wishing to be bound by theory, it is believed that incorporation into the oncology-related primary constructs or oncology-related mmRNA of the invention will result in improved therapeutic efficacy due at least in part to the specificity, purity and selectivity of the construct designs.

The oncology-related polynucleotides, oncology-related primary constructs and/or oncology-related mmRNA may alter a biological and/or physiolocial process and/or compound such as, but not limited to, the cell cycle, the DNA damage response (e.g., DNA damage repair), apoptosis, angiogenesis, cell motility, the epithelial to mesenchymal transition in epithelial cells, the phosphatidyl inositol 3 (PI3) kinase/Akt cellular signaling pathway, telomerase activity and/or expression, tumor metastasis, tumorigenesis, cathepsins, cell senescence, receptor tyrosine kinase signaling, metabolism and drug metabolism, G protein signaling, growth factors and receptors, heat shock proteins, histone deacetylases, hormone receptors, hypoxia, poly ADP-ribose polymerases, protein kinases, RAS signaling, topisomerases, transcription factors and tumor suppressor activity in cancerous, precancerous and/or other cells.

In one embodiment, the polynucleotides, oncology-related primary constructs and/or oncology-related mmRNA may used to express a polypeptide in cells or tissues for the purpose of replacing the protein produced from a deleted or mutated gene.

Further, the oncology-related polynucleotides, oncology-related primary constructs or oncology-related mmRNA of the invention may be used to treat cancer which has been caused by carcinogens of natural and/or synthetic origin. In another embodiment, the use of the oncology-related polynucleotides, oncology-related primary constructs and/or oncology-related mmRNA may be used to treat cancer caused by other organisms and/or cancers caused by viral infection.

Flanking Regions: Untranslated Regions (UTRs)

Untranslated regions (UTRs) of a gene are transcribed but not translated. The 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the oncology-related polynucleotides, oncology-related primary constructs and/or oncology-related mmRNA of the present invention to enhance the stability of the molecule. The specific features can also be incorporated to ensure controlled down-regulation of the transcript in case they are misdirected to undesired organs sites.

5' UTR and Translation Initiation

Natural 5'UTRs bear features which play roles in for translation initiation. They harbor signatures like Kozak sequences which are commonly known to be involved in the process by which the ribosome initiates translation of many genes. Kozak sequences have the consensus CCR(A/G)CCAUGG, where R is a purine (adenine or guanine) three bases upstream of the start codon (AUG), which is followed by another 'G'. 5'UTR also have been known to form secondary structures which are involved in elongation factor binding.

By engineering the features typically found in abundantly expressed genes of specific target organs, one can enhance the stability and oncology-related protein production of the oncology-related polynucleotides, oncology-related primary constructs or oncology-related mmRNA of the invention. For example, introduction of 5' UTR of liver-expressed mRNA, such as albumin, serum amyloid A, Apolipoprotein A/B/E, transferrin, alpha fetoprotein, erythropoietin, or Factor VIII, could be used to enhance expression of a nucleic acid molecule, such as a mmRNA, in hepatic cell lines or liver. Likewise, use of 5' UTR from other tissue-specific mRNA to improve expression in that tissue is possible—for muscle (MyoD, Myosin, Myoglobin, Myogenin, Herculin), for endothelial cells (Tie-1, CD36), for myeloid cells (C/EBP, AML1, G-CSF, GM-CSF, CD11b, MSR, Fr-1, i-NOS), for leukocytes (CD45, CD18), for adipose tissue (CD36, GLUT4, ACRP30, adiponectin) and for lung epithelial cells (SP-A/B/C/D).

Other non-UTR sequences may be incorporated into the 5' (or 3' UTR) UTRs. For example, introns or portions of introns sequences may be incorporated into the flanking regions of the oncology-related polynucleotides, oncology-related primary constructs or oncology-related mmRNA of the invention. Incorporation of intronic sequences may increase protein production as well as mRNA levels.

3' UTR and the AU Rich Elements

3'UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA(U/A)(U/A) nonamers. Molecules containing this type of AREs include GM-CSF and TNF-a. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of oncology-related polynucleotides, oncology-related primary constructs or oncology-related mmRNA of the invention. When engineering specific oncology-related polynucleotides, oncology-related primary constructs or oncology-related mmRNA, one or more copies of an ARE can be introduced to make oncology-related polynucleotides, oncology-related primary constructs or oncology-related mmRNA of the invention less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using oncology-related polynucleotides, oncology-related primary constructs or oncology-related mmRNA of the invention and protein production can be assayed at various time points post-transfection. For example, cells can be transfected with different ARE-engineering molecules and by using an ELISA kit to the relevant protein and assaying protein produced at 6 hour, 12 hour, 24 hour, 48 hour, and 7 days post-transfection.

Incorporating microRNA Binding Sites microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The oncology-related polynucleotides, oncology-related primary constructs or oncology-related mmRNA of the invention may comprise one or more microRNA target sequences, microRNA sequences, or microRNA seeds. Such sequences may correspond to any known microRNA such as those taught in US Publication US2005/0261218 and US Publication US2005/0059005, the contents of which are incorporated herein by reference in their entirety.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked byan adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105; each of which is herein incorporated by reference in their entirety. The bases of the microRNA seed have complete complementarity with the target sequence. By engineering microRNA target sequences into the 3'UTR of oncology-related polynucleotides, oncology-related primary constructs or oncology-related mmRNA of the invention one can target the molecule for degradation or reduced translation, provided the microRNA in question is available. This process will reduce the hazard of off target effects upon nucleic acid molecule delivery. Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; each of which is herein incorporated by reference in their entirety).

For example, if the nucleic acid molecule is an mRNA and is not intended to be delivered to the liver but ends up there, then miR-122, a microRNA abundant in liver, can inhibit the expression of the gene of interest if one or multiple target sites of miR-122 are engineered into the 3'UTR of the oncology-related polynucleotides, oncology-related primary constructs or oncology-related mmRNA. Introduction of one or multiple binding sites for different microRNA can be engineered to further decrease the longevity, stability, and protein translation of oncology-related polynucleotides, oncology-related primary constructs or oncology-related mmRNA. As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the oncology-related polynucleotides, oncology-related primary constructs or oncology-related mmRNA of the present invention, microRNA binding sites can be engineered out of (i.e. removed from) sequences in which they naturally occur in order to increase protein expression in specific tissues. For example, miR-122 binding sites may be removed to improve protein expression in the liver. Regulation of expression in multiple tissues can be accomplished through introduction or removal or one or several microRNA binding sites.

Examples of tissues where microRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126). MicroRNA can also regulate complex biological processes such as angiogenesis (miR-132) (Anand and Cheresh Curr Opin Hematol 2011 18:171-176; herein incorporated by reference in its entirety). In the oncology-related polynucleotides, oncology-related primary constructs or oncology-related mmRNA of the present invention, binding sites for microRNAs that are involved in such processes may be removed or introduced, in order to tailor the expression of the oncology-related polynucleotides, oncology-related primary constructs or oncology-related mmRNA expression to biologically relevant cell types or to the context of relevant biological processes. A listing of MicroRNA, miR sequences and miR binding sites is listed in Table 9 of U.S. Provisional Application No. 61/753,661 filed Jan. 17, 2013, in Table 9 of U.S. Provisional Application No. 61/754,159 filed Jan. 18, 2013, and in Table 7 of U.S. Provisional Application No. 61/758,921 filed Jan. 31, 2013, each of which are herein incorporated by reference in their entireties.

Lastly, through an understanding of the expression patterns of microRNA in different oncology-related cell types, oncology-related polynucleotides, oncology-related primary constructs or oncology-related mmRNA can be engineered for more targeted expression in specific cell types or only under specific biological conditions. Through introduction of tissue-specific microRNA binding sites, oncology-related polynucleotides, oncology-related primary constructs or oncology-related mmRNA could be designed that would be optimal for oncology-related protein expression in a tissue or in the context of a biological condition. Examples of use of microRNA to drive tissue or disease-specific gene expression are listed (Getner and Naldini, Tissue Antigens. 2012, 80:393-403; herein incorporated by reference in its entirety). In addition, microRNA seed sites can be incorporated into mRNA to decrease expression in certain cells which results in a biological improvement. An example of this is incorporation of miR-142 sites into a UGT1A1-expressing lentiviral vector. The presence of miR-142 seed sites reduced expression in hematopoietic cells, and as a consequence reduced expression in antigen-presentating cells, leading to the absence of an immune response against the virally expressed UGT1A1 (Schmitt et al., Gastroenterology 2010; 139:999-1007; Gonzalez-Asequinolaza et al. Gastroenterology 2010, 139:726-729; each of which are herein incorporated by reference in their entirety). Incorporation of miR-142 sites into modified mRNA could not only reduce expression of the encoded protein in hematopoietic cells, but could also reduce or abolish immune responses to the mRNA-encoded protein. Incorporation of miR-142 seed sites (one or multiple) into mRNA would be important in the case of treatment of patients with complete protein deficiencies such as, but not limited to, UGT1A1 type I, LDLR-deficient patients abd GRIM-negative Pompe patients.

Transfection experiments can be conducted in relevant cell lines, using engineered oncology-related polynucleotides, oncology-related primary constructs or oncology-related mmRNA and protein production can be assayed at various time points post-transfection. For example, cells can be transfected with different microRNA binding site-engineering oncology-related polynucleotides, oncology-related primary constructs or oncology-related mmRNA and by using an ELISA kit to the relevant protein and assaying protein produced at 6 hour, 12 hour, 24 hour, 48 hour, 72 hour and 7 days post-transfection. In vivo experiments can also be conducted using microRNA-binding site-engineered molecules to examine changes in tissue-specific expression of formulated oncology-related polynucleotides, oncology-related primary constructs or oncology-related mmRNA.

5' Capping

The 5' cap structure of an mRNA is involved in nuclear export, increasing mRNA stability and binds the mRNA Cap Binding Protein (CBP), which is responsibile for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

Modifications to the oncology-related polynucleotides, oncology-related primary constructs, and oncology-related mmRNA of the present invention may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with α-thio-guanosine nucleotides according to the manufacturer's instructions to create a phosphorothioate linkage in the 5'-ppp-5' cap. Additional modified guanosine nucleotides may be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the mRNA (as mentioned above) on the 2'-hydroxyl group of the sugar ring. Multiple distinct 5'-cap structures can be used to generate the 5'-cap of a nucleic acid molecule, such as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/or linked to a nucleic acid molecule.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3' mppp-G; which may equivalently be designated 3' O-Me-m7G(5')ppp(5')G). The 3'-O atom of the other, unmodified, guanine becomes linked to the 5'-terminal nucleotide of the capped nucleic acid molecule (e.g. an mRNA or mmRNA). The N7- and 3'-O-methlyated guanine provides the terminal moiety of the capped nucleic acid molecule (e.g. mRNA or mmRNA).

Another exemplary cap is mCAP, which is similar to ARCA but has a 2'-β-methyl group on guanosine (i.e., N7,2'-O-dimethyl-guanosine-5'-triphosphate-5'-guanosine, m$^7$Gm-ppp-G).

While cap analogs allow for the concomitant capping of a nucleic acid molecule in an in vitro transcription reaction, up to 20% of transcripts can remain uncapped. This, as well as the structural differences of a cap analog from an endogenous 5'-cap structures of nucleic acids produced by the endogenous, cellular transcription machinery, may lead to reduced translational competency and reduced cellular stability.

Oncology-related polynucleotides, oncology-related primary constructs and oncology-related mmRNA of the invention may also be capped post-transcriptionally, using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5' cap structures of the present invention are those which, among other things, have enhanced binding of cap binding proteins, increased half life, reduced susceptibility to 5' endonucleases and/or reduced 5' decapping, as compared to synthetic 5' cap structures known in the art (or to a wild-type, natural or physiological 5' cap structure). For example, recombinant Vaccinia Virus Capping Enzyme and recombinant 2'-O-methyltransferase enzyme can create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5' cap analog structures known in the art. Cap structures include, but are not limited to, 7mG(5')ppp(5')N,pN2p (cap 0), 7mG(5')ppp(5')N1mpNp (cap 1), and 7mG(5')-ppp(5')N1mpN2 mp (cap 2).

Because the oncology-related polynucleotides, oncology-related primary constructs or oncology-related mmRNA may be capped post-transcriptionally, and because this process is more efficient, nearly 100% of the oncology-related polynucleotides, oncology-related primary constructs or oncology-related mmRNA may be capped. This is in contrast to ~80% when a cap analog is linked to an mRNA in the course of an in vitro transcription reaction.

According to the present invention, 5' terminal caps may include endogenous caps or cap analogs. According to the present invention, a 5' terminal cap may comprise a guanine analog. Useful guanine analogs include, but are not limited to, inosine, N1-methyl-guanosine, 2' fluoro-guanosine, 7-deaza-guanosine, 8-oxo-guanosine, 2-amino-guanosine, LNA-guanosine, and 2-azido-guanosine.

Viral Sequences

Additional viral sequences such as, but not limited to, the translation enhancer sequence of the barley yellow dwarf virus (BYDV-PAV), the Jaagsiekte sheep retrovirus (JSRV) and/or the Enzootic nasal tumor virus (See e.g., International Pub. No. WO2012129648; herein incorporated by reference in its entirety) can be engineered and inserted in the 3' UTR of the oncology-related polynucleotides, oncology-related primary constructs or oncology-related mmRNA of the invention and can stimulate the translation of the construct in vitro and in vivo. Transfection experiments can be conducted in relevant cell lines at and protein production can be assayed by ELISA at 12 hr, 24 hr, 48 hr, 72 hr and day 7 post-transfection.

IRES Sequences

Further, provided are oncology-related polynucleotides, oncology-related primary constructs or oncology-related mmRNA which may contain an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. Oncology-related polynucleotides, oncology-related primary constructs or oncology-related mmRNA containing more than one functional ribosome binding site may encode several oncology-related peptides or oncology-related polypeptides that are translated independently by the ribosomes ("multicistronic nucleic acid molecules"). When oncology-related polynucleotides, oncology-related primary constructs or oncology-related mmRNA are provided with an IRES, further optionally provided is a second translatable region. Examples of IRES sequences that can be used according to the invention include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Poly-A Tails

During RNA processing, a long chain of adenine nucleotides (poly-A tail) may be added to a polynucleotide such as an mRNA molecule in order to increase stability. Immediately after transcription, the 3' end of the transcript may be cleaved to free a 3' hydroxyl. Then poly-A polymerase adds a chain of adenine nucleotides to the RNA. The process, called polyadenylation, adds a poly-A tail that can be between, for example, approximately 100 and 250 residues long.

It has been discovered that unique poly-A tail lengths provide certain advantages to the oncology-related polynucleotides, oncology-related primary constructs or oncology-related mmRNA of the present invention.

Generally, the length of a poly-A tail of the present invention is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). In some embodiments, the oncology-related polynucleotide, oncology-related primary construct, or oncology-related mmRNA includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In one embodiment, the poly-A tail is designed relative to the length of the overall oncology-related polynucleotides, oncology-related primary constructs or oncology-related mmRNA. This design may be based on the length of the coding region, the length of a particular feature or region (such as the first or flanking regions), or based on the length of the ultimate product expressed from the oncology-related polynucleotides, oncology-related primary constructs or oncology-related mmRNA.

In this context the poly-A tail may be 10, 20, 30, 40, 50, 60, 70, 80, 90, or 100% greater in length than the oncology-related polynucleotides, oncology-related primary constructs or oncology-related mmRNA or feature thereof. The poly-A tail may also be designed as a fraction of oncology-related polynucleotides, oncology-related primary constructs or oncology-related mmRNA to which it belongs. In this context, the poly-A tail may be 10, 20, 30, 40, 50, 60, 70, 80, or 90% or more of the total length of the construct or the total length of the construct minus the poly-A tail. Further, engineered binding sites and conjugation of oncology-related polynucleotides, oncology-related primary constructs or oncology-related mmRNA for Poly-A binding protein may enhance expression.

Additionally, multiple distinct oncology-related polynucleotides, oncology-related primary constructs or oncology-related mmRNA may be linked together to the PABP (Poly-A binding protein) through the 3'-end using modified nucleotides at the 3'-terminus of the poly-A tail. Transfection experiments can be conducted in relevant cell lines and oncology-related protein production can be assayed by ELISA at 12 hr, 24 hr, 48 hr, 72 hr and day 7 post-transfection.

In one embodiment, the oncology-related polynucleotide and oncology-related primary constructs of the present invention are designed to include a polyA-G Quartet. The G-quartet is a cyclic hydrogen bonded array of four guanine nucleotides that can be formed by G-rich sequences in both DNA and RNA. In this embodiment, the G-quartet is incorporated at the end of the poly-A tail. The resultant oncology-related mmRNA construct is assayed for stability, protein production and other parameters including half-life at various time points. It has been discovered that the polyA-G quartet results in protein production equivalent to at least 75% of that seen using a poly-A tail of 120 nucleotides alone.

Quantification

In one embodiment, the oncology-related polynucleotides, oncology-related primary constructs or oncology-related mmRNA of the present invention may be quantified in exosomes derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

In the quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of an oncology-related polynucleotide, oncology-related primary construct or oncology-related mmRNA may be an expression level, presence, absence, truncation or alteration of the administered construct. It is advantageous to correlate the level with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of oncology-related polynucleotides, oncology-related primary constructs or oncology-related mmRNA remaining or delivered. This is possible because the oncology-related polynucleotides, oncology-related primary constructs or oncology-related mmRNA of the present invention differ from the endogenous forms due to the structural and/or chemical modifications.

II. DESIGN AND SYNTHESIS OF MMRNA

Oncology-related polynucleotides, oncology-related primary constructs or oncology-related mmRNA for use in accordance with the invention may be prepared according to any available technique including, but not limited to chemical synthesis, enzymatic synthesis, which is generally termed in vitro transcription (IVT) or enzymatic or chemical cleavage of a longer precursor, etc. Methods of synthesizing RNAs are known in the art (see, e.g., Gait, M. J. (ed.) *Oligonucleotide synthesis: a practical approach*, Oxford [Oxfordshire], Washington, D.C.: IRL Press, 1984; and Herdewijn, P. (ed.) *Oligonucleotide synthesis: methods and applications*, Methods in Molecular Biology, v. 288 (Clifton, N.J.) Totowa, N.J.: Humana Press, 2005; both of which are incorporated herein by reference).

The process of design and synthesis of the oncology-related primary constructs of the invention generally includes the steps of gene construction, mRNA production (either with or without modifications) and purification. In the enzymatic synthesis method, a target oncology-related polynucleotide sequence encoding the oncology-related polypeptide of interest is first selected for incorporation into a vector which will be amplified to produce a cDNA template. Optionally, the target oncology-related polynucleotide sequence and/or any flanking sequences may be codon optimized. The cDNA template is then used to produce mRNA through in vitro transcription (IVT). After production, the mRNA may undergo purification and clean-up processes. The steps of which are provided in more detail below.

Gene Construction

The step of gene construction may include, but is not limited to gene synthesis, vector amplification, plasmid purification, plasmid linearization and clean-up, and cDNA template synthesis and clean-up.

Gene Synthesis

Once an oncology-related polypeptide of interest, or target, is selected for production, an oncology-related primary construct is designed. Within the oncology-related primary construct, a first region of linked nucleosides encoding the polypeptide of interest may be constructed using an open reading frame (ORF) of a selected nucleic acid (DNA or RNA) transcript. The ORF may comprise the wild type ORF, an isoform, variant or a fragment thereof. As used herein, an "open reading frame" or "ORF" is meant to refer to a nucleic acid sequence (DNA or RNA) which is capable of encoding an oncology-related polypeptide of interest. ORFs often begin with the start codon, ATG and end with a nonsense or termination codon or signal.

Further, the nucleotide sequence of the first region may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the mRNA. Codon optimization tools, algorithms and services are known in the art, non-limiting examples include services from GeneArt (Life Technologies), DNA2.0 (Menlo Park Calif.) and/or proprietary methods. In one embodiment, the ORF sequence is optimized using optimization algorithms. Codon options for each amino acid are given in Table 1.

TABLE 1

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocystein insertion element (SECIS) |
| Stop codons | Stop | TAA, TAG, TGA |

Features, which may be considered beneficial in some embodiments of the present invention, may be encoded by the oncology-related primary construct and may flank the ORF as a first or second flanking region. The flanking regions may be incorporated into the oncology-related primary construct before and/or after optimization of the ORF. It is not required that an oncology-related primary construct contain both a 5' and 3' flanking region. Examples of such features include, but are not limited to, untranslated regions (UTRs), Kozak sequences, an oligo(dT) sequence, and detectable tags and may include multiple cloning sites which may have XbaI recognition.

In some embodiments, a 5' UTR and/or a 3' UTR may be provided as flanking regions. Multiple 5' or 3' UTRs may be included in the flanking regions and may be the same or of different sequences. Any portion of the flanking regions, including none, may be codon optimized and any may independently contain one or more different structural or chemical modifications, before and/or after codon optimization. Combinations of features may be included in the first and second flanking regions and may be contained within other features. For example, the ORF may be flanked by a 5' UTR which may contain a strong Kozak translational initiation signal and/or a 3' UTR which may include an oligo(dT) sequence for templated addition of a poly-A tail. The 5'UTR may comprise a first polynucleotide fragment and a second polynucleotide fragment from the same and/or different genes such as the 5'UTRs described in US Patent Application Publication No. 20100293625, herein incorporated by reference in its entirety.

Tables 2 and 3 provide a listing of exemplary UTRs which may be utilized in the oncology-related primary construct of the present invention as flanking regions. Shown in Table 2 is a listing of a 5'-untranslated region of the invention. Variants of 5' UTRs may be utilized wherein one or more nucleotides are added or removed to the termini, including A, T, C or G.

TABLE 2

5'-Untranslated Regions

| 5' UTR Identifier | Name/ Description | Sequence | SEQ ID NO. |
|---|---|---|---|
| 5UTR-001 | Upstream UTR | GGGAAATAAGAGAGAAAAGAAGAGTAAGAAG AAATATAAGAGCCACC | 1 |
| 5UTR-002 | Upstream UTR | GGGAGATCAGAGAGAAAAGAAGAGTAAGAAG AAATATAAGAGCCACC | 2 |
| 5UTR-003 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 3 |
| 5UTR-004 | Upstream UTR | GGGAGACAAGCUUGGCAUUCCGGUACUGUUG GUAAAGCCACC | 4 |

Shown in Table 3 is a representative listing of 3'-untranslated regions of the invention. Variants of 3' UTRs may be utilized wherein one or more nucleotides are added or removed to the termini, including A, T, C or G.

TABLE 3

3'-Untranslated Regions

| 3' UTR Identifier | Name/ Description | Sequence | SEQ ID NO. |
|---|---|---|---|
| 3UTR-001 | Creatine Kinase | GCGCCTGCCCACCTGCCACCGACTGCTGGAA CCCAGCCAGTGGGAGGGCCTGGCCCACCAGA GTCCTGCTCCCTCACTCCTCGCCCCGCCCCCT GTCCCAGAGTCCCACCTGGGGGCTCTCTCCA CCCTTCTCAGAGTTCCAGTTTCAACCAGAGTT CCAACCAATGGGCTCCATCCTCTGGATTCTG GCCAATGAAATATCTCCCTGGCAGGGTCCTC TTCTTTTCCCAGAGCTCCACCCCAACCAGGA GCTCTAGTTAATGGAGAGCTCCCAGCACACT CGGAGCTTGTGCTTTGTCTCCACGCAAAGCG ATAAATAAAAGCATTGGTGGCCTTTGGTCTT TGAATAAAGCCTGAGTAGGAAGTCTAGA | 5 |
| 3UTR-002 | Myoglobin | GCCCCTGCCGCTCCCACCCCCACCCATCTGG GCCCCGGGTTCAAGAGAGAGCGGGGTCTGAT CTCGTGTAGCCATATAGAGTTTGCTTCTGAGT GTCTGCTTTGTTTAGTAGAGGTGGGCAGGAG GAGCTGAGGGCTGGGGCTGGGGTGTTGAA GTTGGCTTTGCATGCCCAGCGATGCGCCTCC CTGTGGGATGTCATCACCCTGGGAACCGGGA GTGGCCCTTGGCTCACTGTGTTCTGCATGGTT TGGATCTGAATTAATTGTCCTTTCTTCTAAAT CCCAACCGAACTTCTTCCAACCTCCAAACTG GCTGTAACCCCAAATCCAAGCCATTAACTAC ACCTGACAGTAGCAATTGTCTGATTAATCAC TGGCCCCTTGAAGACAGCAGAATGTCCCTTT GCAATGAGGAGGAGATCTGGGCTGGGCGGG CCAGCTGGGGAAGCATTTGACTATCTGGAAC TTGTGTGTGCCTCCTCAGGTATGGCAGTGACT | 6 |

TABLE 3 -continued

3'-Untranslated Regions

| 3' UTR Identifier | Name/ Description | Sequence | SEQ ID NO. |
|---|---|---|---|
| | | CACCTGGTTTTAATAAAACAACCTGCAACAT CTCATGGTCTTTGAATAAAGCCTGAGTAGGA AGTCTAGA | |
| 3UTR-003 | α-actin | ACACACTCCACCTCCAGCACGCGACTTCTCA GGACGACGAATCTTCTCAATGGGGGGCGGC TGAGCTCCAGCCACCCCGCAGTCACTTTCTTT GTAACAACTTCCGTTGCTGCCATCGTAAACT GACACAGTGTTTATAACGTGTACATACATTA ACTTATTACCTCATTTTGTTATTTTTCGAAAC AAAGCCCTGTGGAAGAAAATGGAAAACTTG AAGAAGCATTAAAGTCATTCTGTTAAGCTGC GTAAATGGTCTTTGAATAAAGCCTGAGTAGG AAGTCTAGA | 7 |
| 3UTR-004 | Albumin | CATCACATTTAAAAGCATCTCAGCCTACCAT GAGAATAAGAGAAAGAAAATGAAGATCAAA AGCTTATTCATCTGTTTTTCTTTTTCGTTGGTG TAAAGCCAACACCCTGTCTAAAAAACATAAA TTTCTTTAATCATTTTGCCTCTTTTCTCTGTGC TTCAATTAATAAAAAATGGAAAGAATCTAAT AGAGTGGTACAGCACTGTTATTTTTCAAAGA TGTGTTGCTATCCTGAAAATTCTGTAGGTTCT GTGGAAGTTCCAGTGTTCTCTCTTATTCCACT TCGGTAGAGGATTTCTAGTTTCTTGTGGGCTA ATTAAATAAATCATTAATACTCTTCTAATGGT CTTTGAATAAAGCCTGAGTAGGAAGTCTAGA | 8 |
| 3UTR-005 | α-globin | GCTGCCTTCTGCGGGGCTTGCCTTCTGGCCAT GCCCTTCTTCTCTCCCTTGCACCTGTACCTCT TGGTCTTTGAATAAAGCCTGAGTAGGAAGGC GGCCGCTCGAGCATGCATCTAGA | 9 |
| 3UTR-006 | G-CSF | GCCAAGCCCTCCCCATCCCATGTATTTATCTC TATTTAATATTTATGTCTATTTAAGCCTCATA TTTAAAGACAGGGAAGAGCAGAACGGAGCC CCAGGCCTCTGTGTCCTTCCCTGCATTTCTGA GTTTCATTCTCCTGCCTGTAGCAGTGAGAAA AAGCTCCTGTCCTCCCATCCCCTGGACTGGG AGGTAGATAGGTAAATACCAAGTATTTATTA CTATGACTGCTCCCCAGCCCTGGCTCTGCAAT GGGCACTGGGATGAGCCGCTGTGAGCCCCTG GTCCTGAGGGTCCCCACCTGGGACCCTTGAG AGTATCAGGTCTCCCACGTGGGAGACAAGAA ATCCCTGTTTAATATTTAAACAGCAGTGTTCC CCATCTGGGTCCTTGCACCCCTCACTCTGGCC TCAGCCGACTGCACAGCGGCCCCTGCATCCC CTTGGCTGTGAGGCCCCTGGACAAGCAGAGG TGGCCAGAGCTGGGAGGCATGGCCCTGGGGT CCCACGAATTTGCTGGGGAATCTCGTTTTTCT TCTTAAGACTTTTGGGACATGGTTTGACTCCC GAACATCACCGACGCGTCTCCTGTTTTTCTGG GTGGCCTCGGGACACCTGCCCTGCCCCCACG AGGGTCAGGACTGTGACTCTTTTTAGGGCCA GGCAGGTGCCTGGACATTTGCCTTGCTGGAC GGGGACTGGGGATGTGGGAGGGAGCAGACA GGAGGAATCATGTCAGGCCTGTGTGTGAAAG GAAGCTCCACTGTCACCCTCCACCTCTTCACC CCCCACTCACCAGTGTCCCCTCCACTGTCACA TTGTAACTGAACTTCAGGATAATAAAGTGTT TGCCTCCATGGTCTTTGAATAAAGCCTGAGT AGGAAGGCGGCCGCTCGAGCATGCATCTAGA | 10 |
| 3UTR-007 | Col1a2; collagen, type I, alpha 2 | ACTCAATCTAAATTAAAAAAGAAAGAAATTT GAAAAAACTTTCTCTTTGCCATTTCTTCTTCT TCTTTTTTAACTGAAAGCTGAATCCTTCCATT TCTTCTGCACATCTACTTGCTTAAATTGTGGG CAAAAGAGAAAAAGAAGGATTGATCAGAGC ATTGTGCAATACAGTTTCATTAACTCCTTCCC CCGCTCCCCCAAAAATTTGAATTTTTTTTCA ACACTCTTACACCTGTTATGGAAAATGTCAA CCTTTGTAAGAAAACCAAAATAAAAATTGAA AAATAAAAACCATAAACATTTGCACCACTTG TGGCTTTTGAATATCTTCCACAGAGGGAAGT | 11 |

TABLE 3 -continued

3'-Untranslated Regions

| 3' UTR Identifier | Name/ Description | Sequence | SEQ ID NO. |
|---|---|---|---|
| | | TTAAAACCCAAACTTCCAAAGGTTTAAACTA CCTCAAAACACTTTCCCATGAGTGTGATCCA CATTGTTAGGTGCTGACCTAGACAGAGATGA ACTGAGGTCCTTGTTTTGTTTTGTTCATAATA CAAAGGTGCTAATTAATAGTATTTCAGATAC TTGAAGAATGTTGATGGTGCTAGAAGAATTT GAGAAGAAATACTCCTGTATTGAGTTGTATC GTGTGGTGTATTTTTTAAAAAATTTGATTTAG CATTCATATTTTCCATCTTATTCCCAATTAAA AGTATGCAGATTATTTGCCCAAATCTTCTTCA GATTCAGCATTTGTTCTTTGCCAGTCTCATTT TCATCTTCTTCCATGGTTCCACAGAAGCTTTG TTTCTTGGGCAAGCAGAAAAATTAAATTGTA CCTATTTTGTATATGTGAGATGTTTAAATAAA TTGTGAAAAAAATGAAATAAAGCATGTTTGG TTTTCCAAAAGAACATAT | |
| 3UTR-008 | Col6a2; collagen, type VI, alpha 2 | CGCCGCCGCCCGGGCCCCGCAGTCGAGGGTC GTGAGCCCACCCCGTCCATGGTGCTAAGCGG GCCCGGGTCCCACACGGCCAGCACCGCTGCT CACTCGGACGACGCCCTGGGCCTGCACCTCT CCAGCTCCTCCCACGGGGTCCCCGTAGCCCC GGCCCCCGCCCAGCCCCAGGTCTCCCCAGGC CCTCCGCAGGCTGCCCGGCCTCCCTCCCCCTG CAGCCATCCCAAGGCTCCTGACCTACCTGGC CCCTGAGCTCTGGAGCAAGCCCTGACCCAAT AAAGGCTTTGAACCCAT | 12 |
| 3UTR-009 | RPN1; ribophorin I | GGGGCTAGAGCCCTCTCCGCACAGCGTGGAG ACGGGGCAAGGAGGGGGGTTATTAGGATTG GTGGTTTTGTTTTGCTTTGTTTAAAGCCGTGG GAAAATGGCACAACTTTACCTCTGTGGGAGA TGCAACACTGAGAGCCAAGGGGTGGGAGTT GGGATAATTTTTATATAAAAGAAGTTTTTCC ACTTTGAATTGCTAAAAGTGGCATTTTTCCTA TGTGCAGTCACTCCTCTCATTTCTAAAATAGG GACGTGGCCAGGCACGGTGGCTCATGCCTGT AATCCCAGCACTTTGGGAGGCCGAGGCAGGC GGCTCACGAGGTCAGGAGATCGAGACTATCC TGGCTAACACGGTAAAACCCTGTCTCTACTA AAAGTACAAAAAATTAGCTGGGCGTGGTGGT GGGCACCTGTAGTCCCAGCTACTCGGGAGGC TGAGGCAGGAGAAAGGCATGAATCCAAGAG GCAGAGCTTGCAGTGAGCTGAGATCACGCCA TTGCACTCCAGCCTGGGCAACAGTGTTAAGA CTCTGTCTCAAATATAAATAAATAAATAAAT AAATAAATAAATAAATAAAAATAAAGCGAG ATGTTGCCCTCAAA | 13 |
| 3UTR-010 | LRP1; low density lipoprotein receptor-related protein 1 | GGCCCTGCCCCGTCGGACTGCCCCCAGAAAG CCTCCTGCCCCCTGCCAGTGAAGTCCTTCAGT GAGCCCCTCCCCAGCCAGCCCTTCCCTGGCC CCGCCGGATGTATAAATGTAAAAATGAAGGA ATTACATTTTATATGTGAGCGAGCAAGCCGG CAAGCGAGCACAGTATTATTTCTCCATCCCCT CCCTGCCTGCTCCTTGGCACCCCCATGCTGCC TTCAGGGAGACAGGCAGGGAGGGCTTGGGG CTGCACCTCCTACCCTCCCACCAGAACGCAC CCCACTGGGAGAGCTGGTGGTGCAGCCTTCC CCTCCCTGTATAAGACACTTTGCCAAGGCTCT CCCCTCTCGCCCCATCCCTGCTTGCCCGCTCC CACAGCTTCCTGAGGGCTAATTCTGGGAAGG GAGAGTTCTTTGCTGCCCCTGTCTGGAAGAC GTGGCTCTGGGTGAGGTAGGCGGGAAAGGA TGGAGTGTTTTAGTTCTTGGGGGAGGCCACC CCAAACCCCAGCCCCAACTCCAGGGGCACCT ATGAGATGGCCATGCTCAACCCCCCTCCCAG ACAGGCCCTCCCTGTCTCCAGGGCCCCCACC GAGGTTCCCAGGGCTGGAGACTTCCTCTGGT AAACATTCCTCCAGCCTCCCCTCCCCTGGGG ACGCCAAGGAGGTGGGCCACACCCAGGAAG | 14 |

TABLE 3 -continued

3'-Untranslated Regions

| 3' UTR Identifier | Name/ Description | Sequence | SEQ ID NO. |
|---|---|---|---|
| | | GGAAAGCGGGCAGCCCCGTTTTGGGGACGTG AACGTTTTAATAATTTTTGCTGAATTCCTTTA CAACTAAATAACACAGATATTGTTATAAATA AAATTGT | |
| 3UTR-011 | Nnt1; cardiotrophin-like cytokine factor 1 | ATATTAAGGATCAAGCTGTTAGCTAATAATG CCACCTCTGCAGTTTTGGGAACAGGCAAATA AAGTATCAGTATACATGGTGATGTACATCTG TAGCAAAGCTCTTGGAGAAAATGAAGACTGA AGAAAGCAAAGCAAAAACTGTATAGAGAGA TTTTTCAAAAGCAGTAATCCCTCAATTTTAAA AAAGGATTGAAAATTCTAAATGTCTTTCTGT GCATATTTTTTGTGTTAGGAATCAAAAGTATT TTATAAAAGGAGAAAGAACAGCCTCATTTTA GATGTAGTCCTGTTGGATTTTTTATGCCTCCT CAGTAACCAGAAATGTTTTAAAAAACTAAGT GTTTAGGATTTCAAGACAACATTATACATGG CTCTGAAATATCTGACACAATGTAAACATTG CAGGCACCTGCATTTTATGTTTTTTTTTTCAA CAAATGTGACTAATTTGAAACTTTTATGAAC TTCTGAGCTGTCCCCTTGCAATTCAACCGCAG TTTGAATTAATCATATCAAATCAGTTTTAATT TTTTAAATTGTACTTCAGAGTCTATATTTCAA GGGCACATTTTCTCACTACTATTTTAATACAT TAAAGGACTAAATAATCTTTCAGAGATGCTG GAATACCAATGAAACATACAACTTGAAAATT AGTAATAGTATTTTTGAAGATCCCATTTCTAA TTGGAGATCTCTTTAATTTCGATCAACTTATA ATGTGTAGTACTATATTAAGTGCACTTGAGT GGAATTCAACATTTGACTAATAAAATGAGTT CATCATGTTGGCAAGTGATGTGGCAATTATC TCTGGTGACAAAAGAGTAAAATCAAATATTT CTGCCTGTTACAAATATCAAGGAAGACCTGC TACTATGAAATAGATGACATTAATCTGTCTTC ACTGTTTATAATACGGATGGATTTTTTTCAA ATCAGTGTGTGTTTTGAGGTCTTATGTAATTG ATGACATTTGAGAGAAATGGTGGCTTTTTTT AGCTACCTCTTTGTTCATTTAAGCACCAGTAA AGATCATGTCTTTTTATAGAAGTGTAGATTTT CTTTGTGACTTTGCTATCGTGCCTAAAGCTCT AAATATAGGTGAATGTGTGATGAATACTCAG ATTATTTGTCTCTCTATATAATTAGTTTGGTA CTAAGTTTCTCAAAAAATTATTAACACATGA AAGACAATCTCTAAACCAGAAAAAGAAGTA GTACAAATTTTGTTACTGTAATGCTCGCGTTT AGTGAGTTTAAAACACACAGTATCTTTTGGT TTTATAATCAGTTTCTATTTTGCTGTGCCTGA GATTAAGATCTGTGTATGTGTGTGTGTGTG TGTGCGTTTGTGTGTTAAAGCAGAAAAGACT TTTTTAAAAGTTTTAAGTGATAAATGCAATTT GTTAATTGATCTTAGATCACTAGTAAACTCA GGGCTGAATTATACCATGTATATTCTATTAG AAGAAAGTAAACACCATCTTTATTCCTGCCC TTTTTCTTCTCAAAGTAGTTGTAGTTATAT CTAGAAAGAAGCAATTTTGATTTCTTGAAAA GGTAGTTCCTGCACTCAGTTTAAACTAAAAA TAATCATACTTGGATTTTATTTATTTTTGTCA TAGTAAAAATTTTAATTTATATATATTTTTAT TTAGTATTATCTTATTCTTTGCTATTTGCCAA TCCTTTGTCATCAATTGTGTTAAATGAATTGA AAATTCATGCCCTGTTCATTTTATTTTACTTT ATTGGTTAGGATATTTAAAGGATTTTGTATA TATAATTTCTTAAATTAATATTCCAAAAGGTT AGTGGACTTAGATTATAAATTATGGCAAAAA TCTAAAAACAACAAAAATGATTTTTATACAT TCTATTTCATTATTCCTCTTTTTCCAATAAGTC ATACAATTGGTAGATATGACTTATTTTATTTT TGTATTATTCACTATATCTTTATGATATTTAA GTATAAATAATTAAAAAAATTATTGTACCT TATAGTCTGTCACCAAAAAAAAAAATTATC TGTAGGTAGTGAAATGCTAATGTTGATTTGT CTTTAAGGGCTTGTTAACTATCCTTTATTTTC TCATTTGTCTTAAATTAGGAGTTTGTGTTTAA ATTACTCATCTAAGCAAAAAATGTATATAAA | 15 |

TABLE 3 -continued

3'-Untranslated Regions

| 3' UTR Identifier | Name/ Description | Sequence | SEQ ID NO. |
|---|---|---|---|
| | | TCCCATTACTGGGTATATACCCAAAGGATTA TAAATCATGCTGCTATAAAGACACATGCACA CGTATGTTTATTGCAGCACTATTCACAATAGC AAAGACTTGGAACCAACCCAAATGTCCATCA ATGATAGACTTGATTAAGAAAATGTGCACAT ATACACCATGGAATACTATGCAGCCATAAAA AAGGATGAGTTCATGTCCTTTGTAGGGACAT GGATAAAGCTGGAAACCATCATTCTGAGCAA ACTATTGCAAGGACAGAAAACCAAACACTGC ATGTTCTCACTCATAGGTGGGAATTGAACAA TGAGAACACTTGGACACAAGGTGGGGAACA CCACACACCAGGGCCTGTCATGGGGTGGGGG GAGTGGGGAGGGATAGCATTAGGAGATATA CCTAATGTAAATGATGAGTTAATGGGTGCAG CACACCAACATGGCACATGTATACATATGTA GCAAACCTGCACGTTGTGCACATGTACCCTA GAACTTAAAGTATAATTAAAAAAAAAAAGA AAACAGAAGCTATTTATAAAGAAGTTATTTG CTGAAATAAATGTGATCTTTCCCATTAAAAA AATAAAGAAATTTTGGGGTAAAAAAACACA ATATATTGTATTCTTGAAAAATTCTAAGAGA GTGGATGTGAAGTGTTCTCACCACAAAAGTG ATAACTAATTGAGGTAATGCACATATTAATT AGAAAGATTTTGTCATTCCACAATGTATATA TACTTAAAAATATGTTATACACAATAAATAC ATACATTAAAAAATAAGTAAATGTA | |
| 3UTR-012 | Col6a1; collagen, type VI, alpha 1 | CCCACCCTGCACGCCGGCACCAAACCCTGTC CTCCCACCCCTCCCCACTCATCACTAAACAG AGTAAAATGTGATGCGAATTTTCCCGACCAA CCTGATTCGCTAGATTTTTTTTAAGGAAAAGC TTGGAAAGCCAGGACACAACGCTGCTGCCTG CTTTGTGCAGGGTCCTCCGGGGCTCAGCCCT GAGTTGGCATCACCTGCGCAGGGCCCTCTGG GGCTCAGCCCTGAGCTAGTGTCACCTGCACA GGGCCCTCTGAGGCTCAGCCCTGAGCTGGCG TCACCTGTGCAGGGCCCTCTGGGGCTCAGCC CTGAGCTGGCCTCACCTGGGTTCCCCACCCC GGGCTCTCCTGCCCTGCCCTCCTGCCCGCCCT CCCTCCTGCCTGCGCAGCTCCTTCCCTAGGCA CCTCTGTGCTGCATCCCACCAGCCTGAGCAA GACGCCCTCTCGGGGCCTGTGCCGCACTAGC CTCCCTCTCCTCTGTCCCCATAGCTGGTTTTT CCCACCAATCCTCACCTAACAGTTACTTTACA ATTAAACTCAAAGCAAGCTCTTCTCCTCAGC TTGGGGCAGCCATTGGCCTCTGTCTCGTTTTG GGAAACCAAGGTCAGGAGGCCGTTGCAGAC ATAAATCTCGGCGACTCGGCCCCGTCTCCTG AGGGTCCTGCTGGTGACCGGCCTGGACCTTG GCCCTACAGCCCTGGAGGCCGCTGCTGACCA GCACTGACCCCGACCTCAGAGAGTACTCGCA GGGGCGCTGGCTGCACTCAAGACCCTCGAGA TTAACGGTGCTAACCCCGTCTGCTCCTCCCTC CCGCAGAGACTGGGGCTGGACTGGACATGA GAGCCCCTTGGTGCCACAGAGGGCTGTGTCT TACTAGAAACAACGCAAACCTCTCCTTCCTC AGAATAGTGATGTGTTCGACGTTTTATCAAA GGCCCCCTTTCTATGTTCATGTTAGTTTTGCT CCTTCTGTGTTTTTTCTGAACCATATCCATG TTGCTGACTTTTCCAAATAAAGGTTTTCACTC CTCTC | 16 |
| 3UTR-013 | Calr; calreticulin | AGAGGCCTGCCTCCAGGGCTGGACTGAGGCC TGAGCGCTCCTGCCGCAGAGCTGGCCGCGCC AAATAATGTCTCTGTGAGACTCGAGAACTTT CATTTTTTTCCAGGCTGGTTCGGATTTGGGGT GGATTTTGGTTTTGTTCCCCTCCTCCACTCTC CCCCACCCCCTCCCCGCCCTTTTTTTTTTTTT TTTTAAACTGGTATTTTATCTTTGATTCTCCTT CAGCCCTCACCCCTGGTTCTCATCTTTCTTGA TCAACATCTTTTCTTGCCTCTGTCCCCTTCTCT CATCTCTTAGCTCCCCTCCAACCTGGGGGGC AGTGGTGTGGAGAAGCCACAGGCCTGAGATT TCATCTGCTCTCCTTCCTGGAGCCCAGAGGA | 17 |

TABLE 3 -continued

3'-Untranslated Regions

| 3' UTR Identifier | Name/ Description | Sequence | SEQ ID NO. |
|---|---|---|---|
| | | GGGCAGCAGAAGGGGGTGGTGTCTCCAACCC CCCAGCACTGAGGAAGAACGGGGCTCTTCTC ATTTCACCCCTCCCTTTCTCCCCTGCCCCCAG GACTGGGCCACTTCTGGGTGGGGCAGTGGGT CCCAGATTGGCTCACACTGAGAATGTAAGAA CTACAAACAAAATTTCTATTAAATTAAATTTT GTGTCTCC | |
| 3UTR-014 | Col1a1; collagen, type I, alpha 1 | CTCCCTCCATCCCAACCTGGCTCCCTCCCACC CAACCAACTTTCCCCCCAACCCGGAAACAGA CAAGCAACCCAAACTGAACCCCCTCAAAAGC CAAAAAATGGGAGACAATTTCACATGGACTT TGGAAAATATTTTTTTCCTTTGCATTCATCTC TCAAACTTAGTTTTTATCTTTGACCAACCGAA CATGACCAAAAACCAAAAGTGCATTCAACCT TACCAAAAAAAAAAAAAAAAAAAAGAATAAA TAAATAACTTTTTAAAAAAGGAAGCTTGGTC CACTTGCTTGAAGACCCATGCGGGGGTAAGT CCCTTTCTGCCCGTTGGGCTTATGAAACCCCA ATGCTGCCCTTTCTGCTCCTTTCTCCACACCC CCCTTGGGGCCTCCCCTCCACTCCTTCCCAAA TCTGTCTCCCCAGAAGACACAGGAAACAATG TATTGTCTGCCCAGCAATCAAAGGCAATGCT CAAACACCCAAGTGGCCCCCACCCTCAGCCC GCTCCTGCCCGCCCAGCACCCCCAGGCCCTG GGGGACCTGGGGTTCTCAGACTGCCAAAGAA GCCTTGCCATCTGGCGCTCCCATGGCTCTTGC AACATCTCCCCTTCGTTTTTGAGGGGGTCATG CCGGGGGAGCCACCAGCCCCTCACTGGGTTC GGAGGAGAGTCAGGAAGGGCCACGACAAAG CAGAAACATCGGATTTGGGGAACGCGTGTCA ATCCCTTGTGCCGCAGGGCTGGGCGGGAGAG ACTGTTCTGTTCCTTGTGTAACTGTGTTGCTG AAAGACTACCTCGTTCTTGTCTTGATGTGTCA CCGGGGCAACTGCCTGGGGGCGGGGATGGG GGCAGGGTGGAAGCGGCTCCCCATTTTATAC CAAAGGTGCTACATCTATGTGATGGGTGGGG TGGGGAGGGAATCACTGGTGCTATAGAAATT GAGATGCCCCCCCAGGCCAGCAAATGTTCCT TTTTGTTCAAAGTCTATTTTTATTCCTTGATAT TTTTCTTTTTTTTTTTTTTTTTGTGGATGGG GACTTGTGAATTTTCTAAAGGTGCTATTTAA CATGGGAGGAGAGCGTGTGCGGCTCCAGCCC AGCCCGCTGCTCACTTTCCACCCTCTCTCCAC CTGCCTCTGGCTTCTCAGGCCTCTGCTCTCCG ACCTCTCTCCTCTGAAACCCTCCTCCACAGCT GCAGCCCATCCTCCCGGCTCCCTCCTAGTCTG TCCTGCGTCCTCTCTGTCCCCGGGTTTCAGAGAC AACTTCCCAAAGCACAAAGCAGTTTTTCCCC CTAGGGGTGGGAGGAAGCAAAAGACTCTGT ACCTATTTTGTATGTGTATAATAATTTGAGAT GTTTTTAATTATTTTGATTGCTGGAATAAAGC ATGTGGAAATGACCCAAACATAATCCGCAGT GGCCTCCTAATTTCCTTCTTTGGAGTTGGGGG AGGGGTAGACATGGGGAAGGGGCTTTGGGG TGATGGGCTTGCCTTCCATTCCTGCCCTTTCC CTCCCCACTATTCTCTTCTAGATCCCTCCATA ACCCCACTCCCCTTTCTCTCACCCTTCTTATA CCGCAAACCTTTCTACTTCCTCTTTCATTTTCT ATTCTTGCAATTTCCTTGCACCTTTTCCAAAT CCTCTTCTCCCCTGCAATACCATACAGGCAAT CCACGTGCACAACACACACACACACTCTTCA CATCTGGGGTTGTCCAAACCTCATACCCACT CCCCTTCAAGCCCATCCACTCTCCACCCCCTG GATGCCCTGCACTTGGTGGCGGTGGGATGCT CATGGATACTGGGAGGGTGAGGGGAGTGGA ACCCGTGAGGAGGACCTGGGGGCCTCTCCTT GAACTGACATGAAGGGTCATCTGGCCTCTGC TCCCTTCTCACCCACGCTGACCTCCTGCCGAA GGAGCAACGCAACAGGAGAGGGGTCTGCTG AGCCTGGCGAGGGTCTGGGAGGGACCAGGA GGAAGGCGTGCTCCCTGCTCGCTGTCCTGGC CCTGGGGGAGTGAGGGAGACAGACACCTGG GAGAGCTGTGGGGAAGGCACTCGCACCGTGC | 18 |

TABLE 3 -continued

3'-Untranslated Regions

| 3' UTR Identifier | Name/ Description | Sequence | SEQ ID NO. |
|---|---|---|---|
| | | TCTTGGGAAGGAAGGAGACCTGGCCCTGCTC ACCACGGACTGGGTGCCTCGACCTCCTGAAT CCCCAGAACACAACCCCCCTGGGCTGGGGTG GTCTGGGGAACCATCGTGCCCCCGCCTCCCG CCTACTCCTTTTTAAGCTT | |
| 3UTR-015 | Plod1; procollagen-lysine, 2-oxoglutarate 5-dioxygenase 1 | TTGGCCAGGCCTGACCCTCTTGGACCTTTCTT CTTTGCCGACAACCACTGCCCAGCAGCCTCT GGGACCTCGGGGTCCCAGGGAACCCAGTCCA GCCTCCTGGCTGTTGACTTCCCATTGCTCTTG GAGCCACCAATCAAAGAGATTCAAAGAGATT CCTGCAGGCCAGAGGCGGAACACACCTTTAT GGCTGGGGCTCTCCGTGGTGTTCTGGACCCA GCCCCTGGAGACACCATTCACTTTTACTGCTT TGTAGTGACTCGTGCTCTCCAACCTGTCTTCC TGAAAAACCAAGGCCCCCTTCCCCCACCTCT TCCATGGGGTGAGACTTGAGCAGAACAGGG GCTTCCCCAAGTTGCCCAGAAAGACTGTCTG GGTGAGAAGCCATGGCCAGAGCTTCTCCCAG GCACAGGTGTTGCACCAGGGACTTCTGCTTC AAGTTTTGGGGTAAAGACACCTGGATCAGAC TCCAAGGGCTGCCCTGAGTCTGGGACTTCTG CCTCCATGGCTGGTCATGAGAGCAAACCGTA GTCCCCTGGAGACAGCGACTCCAGAGAACCT CTTGGGAGACAGAAGAGGCATCTGTGCACAG CTCGATCTTCTACTTGCCTGTGGGAGGGGA GTGACAGGTCCACACACCACACTGGGTCACC CTGTCCTGGATGCCTCTGAAGAGAGGGACAG ACCGTCAGAAACTGGAGAGTTTCTATTAAAG GTCATTTAAACCA | 19 |
| 3UTR-016 | Nucb1; nucleobindin 1 | TCCTCCGGGACCCCAGCCCTCAGGATTCCTG ATGCTCCAAGGCGACTGATGGGCGCTGGATG AAGTGGCACAGTCAGCTTCCCTGGGGGCTGG TGTCATGTTGGGCTCCTGGGGCGGGGCACG GCCTGGCATTTCACGCATTGCTGCCACCCCA GGTCCACCTGTCTCCACTTTCACAGCCTCCAA GTCTGTGGCTCTTCCCTTCTGTCCTCCGAGGG GCTTGCCTTCTCTCGTGTCCAGTGAGGTGCTC AGTGATCGGCTTAACTTAGAGAAGCCCGCCC CCTCCCCTTCTCCGTCTGTCCCAAGAGGGTCT GCTCTGAGCCTGCGTTCCTAGGTGGCTCGGC CTCAGCTGCCTGGGTTGTGGCCGCCCTAGCA TCCTGTATGCCCACAGCTACTGGAATCCCCG TCGCTGCTCCGGGCCAAGCTTCTGGTTGATTA ATGAGGGCATGGGTGGTCCCTCAAGACCTT CCCCTACCTTTTGTGGAACCAGTGATGCCTCA AAGACAGTGTCCCCTCCACAGCTGGGTGCCA GGGGCAGGGGATCCTCAGTATAGCCGGTGAA CCCTGATACCAGGAGCCTGGGCCTCCCTGAA CCCCTGGCTTCCAGCCATCTCATCGCCAGCCT CCTCCTGGACCTCTTGGCCCCCAGCCCCTTCC CCACACAGCCCCAGAAGGGTCCCAGAGCTGA CCCCACTCCAGGACCTAGGCCCAGCCCCTCA GCCTCATCTGGAGCCCCTGAAGACCAGTCCC ACCCACCTTTCTGGCCTCATCTGACACTGCTC CGCATCCTGCTGTGTGTCCTGTTCCATGTTCC GGTTCCATCCAAATACACTTTCTGGAACAAA | 20 |
| 3UTR-017 | α-globin | GCTGGAGCCTCGGTGGCCATGCTTCTTGCCC CTTGGGCCTCCCCCCAGCCCCTCCTCCCCTTC CTGCACCCGTACCCCCGTGGTCTTTGAATAA AGTCTGAGTGGGCGGC | 21 |

It should be understood that those listed in the previous tables are examples and that any UTR from any gene may be incorporated into the respective first or second flanking region of the primary construct. Furthermore, multiple wild-type UTRs of any known gene may be utilized. It is also within the scope of the present invention to provide artificial UTRs which are not variants of wild type genes. These UTRs or portions thereof may be placed in the same orientation as in the transcript from which they were selected or may be altered in orientation or location. Hence a 5' or 3' UTR may be inverted, shortened, lengthened, made chimeric with one or more other 5' UTRs or 3' UTRs. As used herein, the term "altered" as it relates to a UTR sequence, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In one embodiment, a double, triple or quadruple UTR such as a 5' or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present invention to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In one embodiment, flanking regions are selected from a family of transcripts whose proteins share a common function, structure, feature of property. For example, oncology-related polypeptides of interest may belong to a family of proteins which are expressed in a particular cell, tissue or at some time during development. The UTRs from any of these genes may be swapped for any other UTR of the same or different family of proteins to create a new chimeric primary transcript. As used herein, a "family of proteins" is used in the broadest sense to refer to a group of two or more oncology-related polypeptides of interest which share at least one function, structure, feature, localization, origin, or expression pattern.

After optimization (if desired), the oncology-related primary construct components are reconstituted and transformed into a vector such as, but not limited to, plasmids, viruses, cosmids, and artificial chromosomes. For example, the optimized construct may be reconstituted and transformed into chemically competent *E. coli*, yeast, *neurospora*, maize, *drosophila*, etc. where high copy plasmid-like or chromosome structures occur by methods described herein.

The untranslated region may also include translation enhancer elements (TEE). As a non-limiting example, the TEE may include those described in US Application No. 20090226470, herein incorporated by reference in its entirety, and those known in the art.

Stop Codons

In one embodiment, the oncology-related primary constructs of the present invention may include at least two stop codons before the 3' untranslated region (UTR). The stop codon may be selected from TGA, TAA and TAG. In one embodiment, the oncology-related primary constructs of the present invention include the stop codon TGA and one additional stop codon. In a further embodiment the addition stop codon may be TAA. In another embodiment, the primary constructs of the present invention include three stop codons.

Vector Amplification

The vector containing the oncology-related primary construct is then amplified and the plasmid isolated and purified using methods known in the art such as, but not limited to, a maxi prep using the Invitrogen PURELINK™ HiPure Maxiprep Kit (Carlsbad, Calif.).

Plasmid Linearization

The plasmid may then be linearized using methods known in the art such as, but not limited to, the use of restriction enzymes and buffers. The linearization reaction may be purified using methods including, for example Invitrogen's PURELINK™ PCR Micro Kit (Carlsbad, Calif.), and HPLC based purification methods such as, but not limited to, strong anion exchange HPLC, weak anion exchange HPLC, reverse phase HPLC (RP-HPLC), and hydrophobic interaction HPLC (HIC-HPLC) and Invitrogen's standard PURELINK™ PCR Kit (Carlsbad, Calif.). The purification method may be modified depending on the size of the linearization reaction which was conducted. The linearized plasmid is then used to generate cDNA for in vitro transcription (IVT) reactions.

cDNA Template Synthesis

A cDNA template may be synthesized by having a linearized plasmid undergo polymerase chain reaction (PCR). Table 4 is a listing of primers and probes that may be useful in the PCR reactions of the present invention. It should be understood that the listing is not exhaustive and that primer-probe design for any amplification is within the skill of those in the art. Probes may also contain chemically modified bases to increase base-pairing fidelity to the target molecule and base-pairing strength. Such modifications may include 5-methyl-Cytidine, 2,6-di-amino-purine, 2'-fluoro, phosphoro-thioate, or locked nucleic acids.

TABLE 4

Primers and Probes

| Primer/Probe Identifier | Sequence (5'-3') | Hybridization target | SEQ ID NO. |
|---|---|---|---|
| UFP | TTGGACCCTCGTACAGAAGCTAATACG | cDNA Template | 22 |
| URP | $T_{x160}$CTTCCTACTCAGGCTTTATTCAAAGACCA | cDNA Template | 23 |
| GBA1 | CCTTGACCTTCTGGAACTTC | Acid glucocerebrosidase | 24 |
| GBA2 | CCAAGCACTGAAACGGATAT | Acid glucocerebrosidase | 25 |
| LUC1 | GATGAAAAGTGCTCCAAGGA | Luciferase | 26 |
| LUC2 | AACCGTGATGAAAAGGTACC | Luciferase | 27 |

TABLE 4 -continued

Primers and Probes

| Primer/<br>Probe<br>Identifier | Sequence (5'-3') | Hybridization<br>target | SEQ<br>ID<br>NO. |
|---|---|---|---|
| LUC3 | TCATGCAGATTGGAAAGGTC | Luciferase | 28 |
| GCSF1 | CTTCTTGGACTGTCCAGAGG | G-CSF | 29 |
| GCSF2 | GCAGTCCCTGATACAAGAAC | G-CSF | 30 |
| GCSF3 | GATTGAAGGTGGCTCGCTAC | G-CSF | 31 |

*UFP is universal forward primer; URP is universal reverse primer.

In one embodiment, the cDNA may be submitted for sequencing analysis before undergoing transcription.

mRNA Production

The process of mRNA or mmRNA production may include, but is not limited to, in vitro transcription, cDNA template removal and RNA clean-up, and mRNA capping and/or tailing reactions.

In Vitro Transcription

The cDNA produced in the previous step may be transcribed using an in vitro transcription (IVT) system. The system typically comprises a transcription buffer, nucleotide triphosphates (NTPs), an RNase inhibitor and a polymerase. The NTPs may be manufactured in house, may be selected from a supplier, or may be synthesized as described herein. The NTPs may be selected from, but are not limited to, those described herein including natural and unnatural (modified) NTPs. The polymerase may be selected from, but is not limited to, T7 RNA polymerase, T3 RNA polymerase and mutant polymerases such as, but not limited to, polymerases able to be incorporated into modified nucleic acids.

RNA Polymerases

Any number of RNA polymerases or variants may be used in the design of the oncology-related primary constructs of the present invention.

RNA polymerases may be modified by inserting or deleting amino acids of the RNA polymerase sequence. As a non-limiting example, the RNA polymerase may be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants may be obtained by evolving an RNA polymerase, optimizing the RNA polymerase amino acid and/or nucleic acid sequence and/or by using other methods known in the art. As a non-limiting example, T7 RNA polymerase variants may be evolved using the continuous directed evolution system set out by Esvelt et al. (Nature (2011) 472(7344):499-503; herein incorporated by reference in its entirety) where clones of T7 RNA polymerase may encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants may encode at least mutation as described in U.S. Pub. Nos. 20100120024 and 20070117112; herein incorporated by reference in their entireties. Variants of RNA polymerase may also include, but are not limited to, substitutional variants, conservative amino acid substitution, insertional variants, deletional variants and/or covalent derivatives.

In one embodiment, the oncology-related primary construct may be designed to be recognized by the wild type or variant RNA polymerases. In doing so, the oncology-related primary construct may be modified to contain sites or regions of sequence changes from the wild type or parent primary construct.

In one embodiment, the oncology-related primary construct may be designed to include at least one substitution and/or insertion upstream of an RNA polymerase binding or recognition site, downstream of the RNA polymerase binding or recognition site, upstream of the TATA box sequence, downstream of the TATA box sequence of the oncology-related primary construct but upstream of the coding region of the oncology-related primary construct, within the 5'UTR, before the 5'UTR and/or after the 5'UTR.

In one embodiment, the 5'UTR of the oncology-related primary construct may be replaced by the insertion of at least one region and/or string of nucleotides of the same base. The region and/or string of nucleotides may include, but is not limited to, at least 3, at least 4, at least 5, at least 6, at least 7 or at least 8 nucleotides and the nucleotides may be natural and/or unnatural. As a non-limiting example, the group of nucleotides may include 5-8 adenine, cytosine, thymine, a string of any of the other nucleotides disclosed herein and/or combinations thereof.

In one embodiment, the 5'UTR of the oncology-related primary construct may be replaced by the insertion of at least two regions and/or strings of nucleotides of two different bases such as, but not limited to, adenine, cytosine, thymine, any of the other nucleotides disclosed herein and/or combinations thereof. For example, the 5'UTR may be replaced by inserting 5-8 adenine bases followed by the insertion of 5-8 cytosine bases. In another example, the 5'UTR may be replaced by inserting 5-8 cytosine bases followed by the insertion of 5-8 adenine bases.

In one embodiment, the oncology-related primary construct may include at least one substitution and/or insertion downstream of the transcription start site which may be recognized by an RNA polymerase. As a non-limiting example, at least one substitution and/or insertion may occur downstream the transcription start site by substituting at least one nucleic acid in the region just downstream of the transcription start site (such as, but not limited to, +1 to +6). Changes to region of nucleotides just downstream of the transcription start site may affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleic acid may cause a silent mutation of the nucleic acid sequence or may cause a mutation in the amino acid sequence.

In one embodiment, the oncology-related primary construct may include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In one embodiment, the oncology-related primary construct may include the substitution of at least 1, at least 2, at least 3, at least 4, at least 5 or at least 6 guanine bases in the region just downstream of the transcription start site. As a non-limiting example, if the nucleotides in the region are GGGAGA the guanine bases may be substituted by at least 1, at least 2, at least 3 or at least 4 adenine nucleotides. In another non-limiting example, if the nucleotides in the region are GGGAGA the guanine bases may be substituted by at least 1, at least 2, at least 3 or at least 4 cytosine bases. In another non-limiting example, if the nucleotides in the region are GGGAGA the guanine bases may be substituted by at least 1, at least 2, at least 3 or at least 4 thymine, and/or any of the nucleotides described herein.

In one embodiment, the oncology-related primary construct may include at least one substitution and/or insertion upstream of the start codon. For the purpose of clarity, one of skill in the art would appreciate that the start codon is the first codon of the protein coding region whereas the transcription start site is the site where transcription begins. The oncology-related primary construct may include, but is not limited to, at least 1, at least 2, at least 3, at least 4, at least 5, at least 6, at least 7 or at least 8 substitutions and/or insertions of nucleotide bases. The nucleotide bases may be inserted or substituted at 1, at least 1, at least 2, at least 3, at least 4 or at least 5 locations upstream of the start codon. The nucleotides inserted and/or substituted may be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the oncology-related primary construct may be substituted with adenine, cytosine, thymine, or any of the nucleotides described herein. In another non-limiting example the substitution of guanine bases in the oncology-related primary construct may be designed so as to leave one guanine base in the region downstream of the transcription start site and before the start codon (see Esvelt et al. Nature (2011) 472(7344): 499-503; herein incorporated by reference in its entirety). As a non-limiting example, at least 5 nucleotides may be inserted at 1 location downstream of the transcription start site but upstream of the start codon and the at least 5 nucleotides may be the same base type.

cDNA Template Removal and Clean-Up

The cDNA template may be removed using methods known in the art such as, but not limited to, treatment with Deoxyribonuclease I (DNase I). RNA clean-up may also include a purification method such as, but not limited to, AGENCOURT® CLEANSEQ® system from Beckman Coulter (Danvers, Mass.), HPLC based purification methods such as, but not limited to, strong anion exchange HPLC, weak anion exchange HPLC, reverse phase HPLC (RP-HPLC), and hydrophobic interaction HPLC (HIC-HPLC).

Capping and/or Tailing Reactions

The oncology-related primary construct or oncology-related mmRNA may also undergo capping and/or tailing reactions. A capping reaction may be performed by methods known in the art to add a 5' cap to the 5' end of the oncology-related primary construct. Methods for capping include, but are not limited to, using a Vaccinia Capping enzyme (New England Biolabs, Ipswich, Mass.).

A poly-A tailing reaction may be performed by methods known in the art, such as, but not limited to, 2' O-methyltransferase and by methods as described herein. If the oncology-related primary construct generated from cDNA does not include a poly-T, it may be beneficial to perform the poly-A-tailing reaction before the oncology-related primary construct is cleaned.

mRNA Purification

Primary construct or mmRNA purification may include, but is not limited to, mRNA or mmRNA clean-up, quality assurance and quality control. mRNA or mmRNA clean-up may be performed by methods known in the arts such as, but not limited to, AGENCOURT® beads (Beckman Coulter Genomics, Danvers, Mass.), poly-T beads, LNA™ oligo-T capture probes (EXIQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified mRNA or mmRNA" refers to one that is separated from at least one contaminant. As used herein, a "contaminant" is any substance which makes another unfit, impure or inferior. Thus, a purified oncology-related polynucleotide (e.g., DNA and RNA) is present in a form or setting different from that in which it is found in nature, or a form or setting different from that which existed prior to subjecting it to a treatment or purification method.

A quality assurance and/or quality control check may be conducted using methods such as, but not limited to, gel electrophoresis, UV absorbance, or analytical HPLC.

In another embodiment, the oncology-related mRNA or oncology-related mmRNA may be sequenced by methods including, but not limited to reverse-transcriptase-PCR.

In one embodiment, the oncology-related mRNA or oncology-related mmRNA may be quantified using methods such as, but not limited to, ultraviolet visible spectroscopy (UV/Vis). A non-limiting example of a UV/Vis spectrometer is a NANODROP® spectrometer (ThermoFisher, Waltham, Mass.). The quantified oncology-related mRNA or oncology-related mmRNA may be analyzed in order to determine if the oncology-related mRNA or oncology-related mmRNA may be of proper size, check that no degradation of the oncology-related mRNA or oncology-related mmRNA has occurred. Degradation of the oncology-related mRNA and/or oncology-related mmRNA may be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Signal Sequences

The oncology-related primary constructs or oncology-related mmRNA may also encode additional features which facilitate trafficking of the oncology-related polypeptides to therapeutically relevant sites. One such feature which aids in protein trafficking is the signal sequence. As used herein, a "signal sequence" or "signal peptide" is a polynucleotide or polypeptide, respectively, which is from about 9 to 200 nucleotides (3-60 amino acids) in length which is incorporated at the 5' (or N-terminus) of the coding region or polypeptide encoded, respectively. Addition of these sequences result in trafficking of the encoded oncology-related polypeptide to the endoplasmic reticulum through one or more secretory pathways. Some signal peptides are cleaved from the protein by signal peptidase after the proteins are transported.

Table 5 is a representative listing of protein signal sequences which may be incorporated for encoding by the oncology-related polynucleotides, oncology-related primary constructs or oncology-related mmRNA of the invention.

TABLE 5

Signal Sequences

| ID | Description | NUCLEOTIDE SEQUENCE (5'-3') | SEQ ID NO. | ENCODED PEPTIDE | SEQ ID NO. |
|---|---|---|---|---|---|
| SS-001 | α-1-antitrypsin | ATGATGCCATCCTCAGT CTCATGGGGTATTTTGC TCTTGGCGGGTCTGTGC TGTCTCGTGCCGGTGTC GCTCGCA | 32 | MMPSSVSWGIL LAGLCCLVPVS LA | 94 |
| SS-002 | G-CSF | ATGGCCGGACCGGCGA CTCAGTCGCCCATGAAA CTCATGGCCCTGCAGTT GTTGCTTTGGCACTCAG CCCTCTGGACCGTCCAA GAGGCG | 33 | MAGPATQSPM KLMALQLLLW HSALWTVQEA | 95 |
| SS-003 | Factor IX | ATGCAGAGAGTGAACA TGATTATGGCCGAGTCC CCATCGCTCATCACAAT CTGCCTGCTTGGTACCT GCTTTCCGCCGAATGCA CTGTCTTTCTGGATCAC GAGAATGCGAATAAGA TCTTGAACCGACCCAAA CGG | 34 | MQRVNMIMAE SPSLITICLLGYL LSAECTVFLDH ENANKILNRPK R | 96 |
| SS-004 | Prolactin | ATGAAAGGATCATTGCT GTTGCTCCTCGTGTCGA ACCTTCTGCTTTGCCAG TCCGTAGCCCCC | 35 | MKGSLLLLLVS NLLLCQSVAP | 97 |
| SS-005 | Albumin | ATGAAATGGGTGACGTT CATCTCACTGTTGTTTTT GTTCTCGTCCGCCTACT CCAGGGGAGTATTCCGC CGA | 36 | MKWVTFISLLF LFSSAYSRG VFRR | 98 |
| SS-006 | HMMSP38 | ATGTGGTGGCGGCTCTG GTGGCTGCTCCTGTTGC TCCTCTTGCTGTGGCCC ATGGTGTGGGCA | 37 | MWWRLWWLL LLLLLLPMWA | 99 |
| MLS-001 | ornithine carbamoyl-transferase | TGCTCTTTAACCTCCGC ATCCTGTTGAATAACGC TGCGTTCCGAAATGGGC ATAACTTCATGGTACGC AACTTCAGATGCGGCCA GCCACTCCAG | 38 | MLFNLRILLNN AAFRNGHNFM VRNFRCGQPLQ | 100 |
| MLS-002 | Cytochrome C Oxidase subunit 8A | ATGTCCGTCTTGACACC CCTGCTCTTGAGAGGGC TGACGGGGTCCGCTAG ACGCCTGCCGGTACCGC GAGCGAAGATCCACTC CCTG | 39 | MSVLTPLLLRG LTGSARRLPVP RAKIHSL | 101 |
| MLS-003 | Cytochrome C Oxidase subunit 8A | ATGAGCGTGCTCACTCC GTTGCTTCTTCGAGGGC TTACGGGATCGGCTCGG AGGTTGCCCGTCCCGAG AGCGAAGATCCATTCGT TG | 40 | MSVLTPLLLRG LTGSARRLPVP RAKIHSL | 102 |
| SS-007 | Type III, bacterial | TGACAAAAATAACTTTA TCTCCCCAGAATTTTAG AATCCAAAAACAGGAA ACCACACTACTAAAAG AAAAATCAACCGAGAA AAATTCTTTAGCAAAAA | 41 | MVTKITLSPQN FRIQKQETTLLK EKSTEKNSLAK SILAVKNHFIEL RSKLSERFISHK NT | 103 |

TABLE 5 -continued

Signal Sequences

| ID | Description | NUCLEOTIDE SEQUENCE (5'-3') | SEQ ID NO. | ENCODED PEPTIDE | SEQ ID NO. |
|---|---|---|---|---|---|
| | | GTATTCTCGCAGTAAAA ATCACTTCATCGAATTA AGGTCAAAATTATCGG AACGTTTTATTTCGCAT AAGAACACT | | | |
| SS-008 | Viral | ATGCTGAGCTTTGTGGA TACCCGCACCCTGCTGC TGCTGGCGGTGACCAGC TGCCTGGCGACCTGCCA G | 42 | MLSFVDTRTLL LLAVTSCLATC Q | 104 |
| SS-009 | viral | ATGGGCAGCAGCCAGG CGCCGCGCATGGGCAG CGTGGGCGGCCATGGC CTGATGGCGCTGCTGAT GGCGGGCCTGATTCTGC CGGGCATTCTGGCG | 43 | MGSSQAPRMGS VGGHGLMALL MAGLILPGILA | 105 |
| SS-010 | Viral | ATGGCGGGCATTTTTTA TTTTCTGTTTAGCTTTTC GTTTGGCATTTGCGAT | 44 | MAGIFYFLFSFL FGICD | 106 |
| SS-011 | Viral | ATGGAAAACCGCCTGCT GCGCGTGTTTCTGGTGT GGGCGGCGCTGACCAT GGATGGCGCGAGCGCG | 45 | MENRLLRVFLV WAALTMDGAS A | 107 |
| SS-012 | Viral | ATGGCGCGCCAGGGCT GCTTTGGCAGCTATCAG GTGATTAGCCTGTTTAC CTTTGCGATTGGCGTGA ACCTGTGCCTGGGC | 46 | MARQGCFGSY QVISLFTFAIGV NLCLG | 108 |
| SS-013 | *Bacillus* | ATGAGCCGCCTGCCGGT GCTGCTGCTGCTGCAGC TGCTGGTGCGCCCGGGC CTGCAG | 47 | MSRLPVLLLLQ LLVRPGLQ | 109 |
| SS-014 | *Bacillus* | ATGAAACAGCAGAAAC GCCTGTATGCGCGCCTG CTGACCCTGCTGTTTGC GCTGATTTTTCTGCTGC CGCATAGCAGCGCGAG CGCG | 48 | MKQQKRLYAR LLTLLFALIFLL PHSSASA | 110 |
| SS-015 | Secretion signal | ATGGCGACGCCGCTGCC TCCGCCCCTCCCCGCGGC ACCTGCGGCTGCTGCGG CTGCTGCTCTCCGCCCT CGTCCTCGGC | 49 | MATPLPPPSPRH LRLLRLLLSG | 111 |
| SS-016 | Secretion signal | ATGAAGGCTCCGGGTC GGCTCGTGCTCATCATC CTGTGCTCCGTGGTCTT CTCT | 50 | MKAPGRLVLIIL CSVVFS | 112 |
| SS-017 | Secretion signal | ATGCTTCAGCTTTGGAA ACTTGTTCTCCTGTGCG GCGTGCTCACT | 51 | MLQLWKLLCG VLT | 113 |
| SS-018 | Secretion signal | ATGCTTTATCTCCAGGG TTGGAGCATGCCTGCTG TGGCA | 52 | MLYLQGWSMP AVA | 114 |
| SS-019 | Secretion signal | ATGGATAACGTGCAGC CGAAAATAAAACATCG CCCCTTCTGCTTCAGTG TGAAAGGCCACGTGAA GATGCTGCGGCTGGATA TTATCAACTCACTGGTA ACAACAGTATTCATGCT CATCGTATCTGTGTTGG CACTGATACCA | 53 | MDNVQPKIKHR PPCFSVKGHVK MLRLDIINSLVT TVFMLIVSVLA LIP | 115 |

TABLE 5 -continued

Signal Sequences

| ID | Description | NUCLEOTIDE SEQUENCE (5'-3') | SEQ ID NO. | ENCODED PEPTIDE | SEQ ID NO. |
|---|---|---|---|---|---|
| SS-020 | Secretion signal | ATGCCCTGCCTAGACCA ACAGCTCACTGTTCATG CCCTACCCTGCCCTGCC CAGCCCTCCTCTCTGGC CTTCTGCCAAGTGGGGT TCTTAACAGCA | 54 | MPCLDQQLTVH ALPCPAQPSSLA FCQVGFLTA | 116 |
| SS-021 | Secretion signal | ATGAAAACCTTGTTCAA TCCAGCCCCTGCCATTG CTGACCTGGATCCCCAG TTCTACACCCTCTCAGA TGTGTTCTGCTGCAATG AAAGTGAGGCTGAGAT TTTAACTGGCCTCACGG TGGGCAGCGCTGCAGA TGCT | 55 | MKTLFNPAPAI ADLDPQFYTLS DVFCCNESEAEI LTGLTVGSAAD A | 117 |
| SS-022 | Secretion signal | ATGAAGCCTCTCCTTGT TGTGTTTGTCTTTCTTTT CCTTTGGGATCCAGTGC TGGCA | 56 | MKPLLVVFVFL FLWDPVLA | 118 |
| SS-023 | Secretion signal | ATGTCCTGTTCCCTAAA GTTTACTTTGATTGTAA TTTTTTTTTACTGTTGGC TTTCATCCAGC | 57 | MSCSLKFTLIVI FFTCTLSSS | 119 |
| SS-024 | Secretion signal | ATGGTTCTTACTAAACC TCTTCAAAGAAATGGCA GCATGATGAGCTTTGAA AATGTGAAAGAAAAGA GCAGAGAAGGAGGGCC CCATGCACACACACCCG AAGAAGAATTGTGTTTC GTGGTAACACACTACCC TCAGGTTCAGACCACAC TCAACCTGTTTTTCCAT ATATTCAAGGTTCTTAC TCAACCACTTTCCCTTC TGTGGGGT | 58 | MVLTKPLQRNG SMMSFENVKEK SREGGPHAHTP EEELCFVVTHT PQVQTTLNLFF HIFKVLTQPLSL LWG | 120 |
| SS-025 | Secretion signal | ATGGCCACCCCGCCATT CCGGCTGATAAGGAAG ATGTTTTCCTTCAAGGT GAGCAGATGGATGGGG CTTGCCTGCTTCCGGTC CCTGGCGGCATCC | 59 | MATPPFRLIRK MFSFKVSRWM GLACFRSLAAS | 121 |
| SS-026 | Secretion signal | ATGAGCTTTTTCCAACT CCTGATGAAAAGGAAG GAACTCATTCCCTTGGT GGTGTTCATGACTGTGG CGGCGGGTGGAGCCTC ATCT | 60 | MSFFQLLMKRK ELIPLVVFMTV AAGGASS | 122 |
| SS-027 | Secretion signal | ATGGTCTCAGCTCTGCG GGGAGCACCCCTGATC AGGGTGCACTCAAGCC CTGTTTCTTCTCCTTCTG TGAGTGGACCACGGAG GCTGGTGAGCTGCCTGT CATCCCAAAGCTCAGCT CTGAGC | 61 | MVSALRGAPLI RVHSSPVSSPSV SGPAALVSCLSS QSSALS | 123 |
| SS-028 | Secretion signal | ATGATGGGGTCCCCAGT GAGTCATCTGCTGGCCG GCTTCTGTGTGTGGGTC GTCTTGGGC | 62 | MMGSPVSHLLA GFCVWVVLG | 124 |

TABLE 5 -continued

Signal Sequences

| ID | Description | NUCLEOTIDE SEQUENCE (5'-3') | SEQ ID NO. | ENCODED PEPTIDE | SEQ ID NO. |
|---|---|---|---|---|---|
| SS-029 | Secretion signal | ATGGCAAGCATGGCTGCCGTGCTCACCTGGGCTCTGGCTCTTCTTTCAGCGTTTTCGGCCACCCAGGCA | 63 | MASMAAVLTWALALLSAFSATQA | 125 |
| SS-030 | Secretion signal | ATGGTGCTCATGTGGACCAGTGGTGACGCCTTCAAGACGGCCTACTTCCTGCTGAAGGGTGCCCCTCTGCAGTTCTCCGTGTGCGGCCTGCTGCAGGTGCTGGTGGACCTGGCCATCCTGGGGCAGGCCTACGCC | 64 | MVLMWTSGDAFKTAYFLLKGAPLQFSVCGLLQVLVDLAILGQATA | 126 |
| SS-031 | Secretion signal | ATGGATTTTGTCGCTGGAGCCATCGGAGGCGTCTGCGGTGTTGCTGTGGGCTACCCCCTGGACACGGTGAAGGTCAGGATCCAGACGGAGCCAAAGTACACAGGCATCTGGCACTGCGTCCGGGATACGTATCACCGAGAGCGCGTGTGGGGCTTCTACCGGGCCTCTCGCTGCCCGTGTGCACGGTGTCCCTGGTATCTTCC | 65 | MDFVAGAIGGVCGVAVGYPLDTVKVRIQTEPLYTGIWHCVRDTYHRERVWGFYRGLSLPVCTVSLVSS | 127 |
| SS-032 | Secretion signal | ATGGAGAAGCCCCTCTTCCCATTAGTGCCTTTGCATTGGTTTGGCTTTGGCTACACAGCACTGGTTGTTTCTGGTGGGATCGTTGGCTATGTAAAAACAGGCAGCGTGCCGTCCCTGGCTGCAGGGCTGCTCTTCGGCAGTCTAGCC | 66 | MEKPLFPLVPLHWFGFGYTALVVSGGIVGYVKTGSVPSLAAGLLFGSLA | 128 |
| SS-033 | Secretion signal | ATGGGTCTGCTCCTTCCCCTGGCACTCTGCATCCTAGTCCTGTGC | 67 | MGLLLPLALCILVLC | 129 |
| SS-034 | Secretion signal | ATGGGGATCCAGACGAGCCCCGTCCTGCTGGCCTCCCTGGGGGTGGGGCTGGTCACTCTGCTCGGCCTGGCTGTGGGC | 68 | MGIQTSPVLLASLGVGLVTLLGLAVG | 130 |
| SS-035 | Secretion signal | ATGTCGGACCTGCTACTACTGGGCCTGATTGGGGGCCTGACTCTCTTACTGCTGCTGACGCTGCTAGCCTTTGCC | 69 | MSDLLLLGLIGGLTLLLLLTLLAFA | 131 |
| SS-036 | Secretion signal | ATGGAGACTGTGGTGATTGTTGCCATAGGTGTGCTGGCCACCATGTTTCTGGCTTCGTTTGCAGCCTTGGTGCTGGTTTGCAGGCAG | 70 | METVVIVAIGVLATIFLASFAALVLVCRQ | 132 |
| SS-037 | Secretion signal | ATGCGCGGCTCTGTGGAGTGCACCTGGGGTTGGGGGCACTGTGCCCCCAGCCCCCTGCTCCTTTGGACTCTACTTCTGTTTGCAGCCCCATTTGGCCTGCTGGGG | 71 | MAGSVECTWGWGHCAPSPLLLWTLLLFAAPFGLLG | 133 |

TABLE 5 -continued

Signal Sequences

| ID | Description | NUCLEOTIDE SEQUENCE (5'-3') | SEQ ID NO. | ENCODED PEPTIDE | SEQ ID NO. |
|---|---|---|---|---|---|
| SS-038 | Secretion signal | ATGATGCCGTCCCGTACCAACCTGGCTACTGGAATCCCCAGTAGTAAAGTGAAATATTCAAGGCTCTCCAGCACAGACGATGGCTACATTGACCTTCAGTTTAAGAAAACCCCTCCTAAGATCCCTTATAAGGCCATCGCACTTGCCACTGTGCTGTTTTTGATTGGCGCC | 72 | MMPSRTNLATGIPSSKVKYSRLSSTDDGYIDLQFKKTPPKIPYKAIALATVLFLIGA | 134 |
| SS-039 | Secretion signal | ATGGCCCTGCCCCAGATGTGTGACGGGAGCCACTTGGCCTCCACCCTCCGCTATTGCATGACAGTCAGCGGCACAGTGGTTCTGGTGGCCGGGACGCTCTGCTTCGCT | 73 | MALPQMCDGSHLASTLRYCMTVSGTVVLVAGTLCFA | 135 |
| SS-041 | Vrg-6 | TGAAAAAGTGGTTCGTTGCTGCCGGCATCGGCGCTGCCGGACTCATGCTCTCCAGCGCCGCCA | 74 | MKKWFVAAGIGAGLLMLSSAA | 136 |
| SS-042 | PhoA | ATGAAACAGAGCACCATTGCGCTGGCGCTGCTGCCGCTGCTGTTTACCCCGGTGACCAAAGCG | 75 | MKQSTIALALLPLLFTPVTKA | 137 |
| SS-043 | OmpA | ATGAAAAAAACCGCGATTGCGATTGCGGTGGCGCTGGCGGGCTTTGCGACCGTGGCGCAGGCG | 76 | MKKTAIAIAVALAGFATVAQA | 138 |
| SS-044 | STI | ATGAAAAAACTGATGCTGGCGATTTTTTTTAGCGTGCTGAGCTTTCCGAGCTTTAGCCAGAGC | 77 | MKKLMLAIFFSVLSFPSFSQS | 139 |
| SS-045 | STII | ATGAAAAAAAACATTGCGTTTCTGCTGGCGAGCATGTTTGTGTTTAGCATTGCGACCAACGCGTATGCG | 78 | MKKNIAFLLASMFVFSIATNAYA | 140 |
| SS-046 | Amylase | ATGTTTGCGAAACGCTTTAAAACCAGCCTGCTGCCGCTGTTTGCGGGCTTTCTGCTGCTGTTTCATCTGGTGCTGGCGGGCCCGGCGGCGGCGAGC | 79 | MFAKRFKTSLLPLFAGFLLLFHLVLAGPAAAS | 141 |
| SS-047 | Alpha Factor | ATGCGCTTTCCGAGCATTTTTTACCGCGGTGCTGTTTGCGGCGAGCAGCGCGCTGGCG | 80 | MRFPSIFTAVLFAASSALA | 142 |
| SS-048 | Alpha Factor | ATGCGCTTTCCGAGCATTTTTTACCACCGTGCTGTTTGCGGCGAGCAGCGCGCTGGCG | 81 | MRFPSIFTTVLFAASSALA | 143 |
| SS-049 | Alpha Factor | ATGCGCTTTCCGAGCATTTTTTACCAGCGTGCTGTTTGCGGCGAGCAGCGCGCTGGCG | 82 | MRFPSIFTSVLFAASSALA | 144 |
| SS-050 | Alpha Factor | ATGCGCTTTCCGAGCATTTTTTACCCATGTGCTGTTTGCGGCGAGCAGCGCGCTGGCG | 83 | MRFPSIFTHVLFAASSALA | 145 |

TABLE 5 -continued

Signal Sequences

| ID | Description | NUCLEOTIDE SEQUENCE (5'-3') | SEQ ID NO. | ENCODED PEPTIDE | SEQ ID NO. |
|---|---|---|---|---|---|
| SS-051 | Alpha Factor | ATGCGCTTTCCGAGCAT TTTTACCATTGTGCTGT TTGCGGCGAGCAGCGC GCTGGCG | 84 | MRFPSIFTIVLF AASSALA | 146 |
| SS-052 | Alpha Factor | ATGCGCTTTCCGAGCAT TTTTACCTTTGTGCTGTT TGCGGCGAGCAGCGCG CTGGCG | 85 | MRFPSIFTFVLF AASSALA | 147 |
| SS-053 | Alpha Factor | ATGCGCTTTCCGAGCAT TTTTACCGAAGTGCTGT TTGCGGCGAGCAGCGC GCTGGCG | 86 | MRFPSIFTEVLF AASSALA | 148 |
| SS-054 | Alpha Factor | ATGCGCTTTCCGAGCAT TTTTACCGGCGTGCTGT TTGCGGCGAGCAGCGC GCTGGCG | 87 | MRFPSIFTGVLF AASSALA | 149 |
| SS-055 | Endoglucanase V | ATGCGTTCCTCCCCCCT CCTCCGCTCCGCCGTTG TGGCCGCCCTGCCGGTG TTGGCCCTTGCC | 88 | MRSSPLLRSAV VAALPVLALA | 150 |
| SS-056 | Secretion signal | ATGGGCGCGGCGGCCG TGCGCTGGCACTTGTGC GTGCTGCTGGCCCTGGG CACACGCGGGCGGCTG | 89 | MGAAAVRWHL CVLLALGTRGR L | 151 |
| SS-057 | Fungal | ATGAGGAGCTCCCTTGT GCTGTTCTTTGTCTCTG CGTGGACGGCCTTGGCC AG | 90 | MRSSLVLFFVS AWTALA | 152 |
| SS-058 | Fibronectin | ATGCTCAGGGGTCCGG GACCCGGGCGGCTGCT GCTGCTAGCAGTCCTGT GCCTGGGGACATCGGT GCGCTGCACCGAAACC GGGAAGAGCAAGAGG | 91 | MLRGPGPGRLL LLAVLCLGTSV RCTETGKSKR | 153 |
| SS-059 | Fibronectin | ATGCTTAGGGGTCCGGG GCCCGGGCTGCTGCTGC TGGCCGTCCAGCTGGGG ACAGCGGTGCCCTCCAC G | 92 | MLRGPGPGLLL LAVQCLGTAVP STGA | 154 |
| SS-060 | Fibronectin | ATGCGCCGGGGGGCCC TGACCGGGCTGCTCCTG GTCCTGTGCCTGAGTGT TGTGCTACGTGCAGCCC CCTCTGCAACAAGCAA GAAGCGCAGG | 93 | MRRGALTGLLL VLCLSVVLRAA PSATSKKRR | 155 |

In the table, SS is secretion signal and MLS is mitochondrial leader signal. The oncology-related primary constructs or oncology-related mmRNA of the present invention may be designed to encode any of the signal sequences of SEQ ID NOs 94-155, or fragments or variants thereof. These sequences may be included at the beginning of the oncology-related polypeptide coding region, in the middle or at the terminus or alternatively into a flanking region. Further, any of the oncology-related polynucleotide primary constructs of the present invention may also comprise one or more of the sequences defined by SEQ ID NOs 32-93. These may be in the first region or either flanking region.

Additional signal sequences which may be utilized in the present invention include those taught in, for example, databases such as those found at www.signalpeptide.de/ or proline.bic.nus.edu.sg/spdb/. Those described in U.S. Pat. Nos. 8,124,379; 7,413,875 and 7,385,034 are also within the scope of the invention and the contents of each are incorporated herein by reference in their entirety.

Target Selection

According to the present invention, the oncology-related primary constructs comprise at least a first region of linked nucleosides encoding at least one oncology-related polypeptide of interest. The oncology-related polypeptides of interest or "targets" or oncology-related proteins and oncology-related peptides of the present invention are listed in Lengthy Table 6 and Table 7. Shown in LengthyTable 6, in addition to the target number (Target No), name and description of the gene encoding the oncology-related polypeptide of interest (Target Description) are the ENSEMBL Transcript ID (ENST) and SEQ ID NO (Trans SEQ ID NO), the ENSEMBL Protein ID (ENSP) and SEQ ID NO (Peptide SEQ ID NO) and when available the optimized transcript and/or ORF sequence identifier (Optim Trans SEQ ID NO or Optimized ORF SEQ ID NO). Shown in Table 7, are familiar cancer syndromes, tumor suppressor genes and sequence identifiers (e.g., ENST SEQ ID for the sequence identifiers associated with the ENSEMBL transcript sequences or ENSP SEQ ID for the sequence identifiers associated with the ENSEMBL protein sequences), function of the tumor suppressor gene, chromosomal location, tumor type observed. For any particular gene there may exist one or more variants or isoforms. Where these exist, they are shown in the tables as well. It will be appreciated by those of skill in the art that disclosed in the Tables are potential flanking regions. These are encoded in each ENST transcript either to the 5' (upstream) or 3' (downstream) of the ORF or coding region. The coding region is definitively and specifically disclosed by teaching the ENSP sequence. Consequently, the sequences taught flanking that encoding the protein are considered flanking regions. It is also possible to further characterize the 5' and 3' flanking regions by utilizing one or more available databases or algorithms. Databases have annotated the features contained in the flanking regions of the ENST transcripts and these are available in the art.

TABLE 7

Familial Cancer Syndrome Targets

| Familial Cancer Syndrome | Tumor Suppressor Gene | ENST SEQ ID | ENSP SEQ ID | Function | Chromosomal Location | Tumor Types Observed |
|---|---|---|---|---|---|---|
| Li-Fraumeni Syndrome | P53 | — | — | cell cycle regulation, apoptosis | 17p13.1 | brain tumors, sarcomas, leukemia, breast cancer |
| Familial Retinoblastoma | RB1 | 3632-3634 | 8169-8171 | cell cycle regulation | 13q14.1-q14.2 | retinoblastoma, osteogenic sarcoma |
| Wilms Tumor | WT1 | 4530-4537 | 9067-9074 | transcriptional regulation | 11p13 | pediatric kidney cancer, most common form of childhood solid tumor |
| Neurofibromatosis Type 1 | NF1 | 2762-2767 | 7299-7304 | catalysis of RAS inactivation | 17q11.2 | neurofibromas, sarcomas, gliomas |
| Neurofibromatosis Type 2 | NF2 | 2768-2780 | 7305-7317 | linkage of cell membrane to actin cytoskeleton | 22q12.2 | Schwann cell tumors, astrocytomas, meningiomas, ependymonas |
| Familial Adenomatous Polyposis | APC | 233-238 | 4781-4786 | signaling through adhesion molecules to nucleus | 5q21-q22 | colon cancer |
| Tuberous sclerosis 1 | TSC1 | 4317-4322 | 8854-8859 | forms complex with TSC2 protein, inhibits signaling to downstream effectors of mTOR | 9q34 | seizures, mental retardation, facial angiofibromas |
| Tuberous sclerosis 2 | TSC2 | 4323-4328 | 8860-8865 | forms complex with TSC1 protein, inhibits signaling to downstream effectors of mTOR | 16p13.3 | benign growths (hamartomas) in many tissues, astrocytomas, rhabdomyosarcomas |
| Deleted in Pancreatic Carcinoma 4, Familial juvenile polyposis syndrome | DPC4, also known as SMAD4 | — | — | regulation of TGF-β/BMP signal transduction | 18q21.1 | pancreatic carcinoma, colon cancer |
| Deleted in Colorectal Carcinoma | DCC | 1329-1332 | 5875-5878 | transmembrane receptor involved in axonal guidance via netrins | 18q21.3 | colorectal cancer |

TABLE 7-continued

Familial Cancer Syndrome Targets

| Familial Cancer Syndrome | Tumor Suppressor Gene | ENST SEQ ID | ENSP SEQ ID | Function | Chromosomal Location | Tumor Types Observed |
|---|---|---|---|---|---|---|
| Familial Breast Cancer | BRCA1 | 57-593 | 5118-5141 | functions in transcription, DNA binding, transcription coupled DNA repair, homologous recombination, chromosomal stability, ubiquitination of proteins, and centrosome replication | 17q21 | breast and ovarian cancer |
| Familial Breast Cancer | BRCA2 (FANCD1) | 594-596 | 5142-5144 | transcriptional regulation of genes involved in DNA repair and homologous recombination | 13q12.3 | breast and ovarian cancer |
| Cowden syndrome | PTEN | 3057 | 7594 | phosphoinositide 3-phosphatase, protein tyrosine phosphatase | 10q23.3 | gliomas, breast cancer, thyroid cancer, head & neck squamous carcinoma |
| Peutz-Jeghers Syndrome (PJS) | STK11 (serine-threonine kinase 11) | 3806-3807 | 8343-8344 | phosphorylates and activates AMP-activated kinase (AMPK), AMPK involved in stress responses, lipid and glucose meatabolism | 19p13.3 | hyperpigmentation, multiple hamartomatous polyps, colorectal, breast and ovarian cancers |
| Hereditary Nonpolyposis Colon Cancer type 1, HNPCC1 | MSH2 | 2607-2616 | 7144-7153 | DNA mismatch repair | 2p22-p21 | colon cancer |
| Hereditary Nonpolyposis Colon Cancer type 2, HNPCC2 | MLH1 | 2588-2599 | 7125-7136 | DNA mismatch repair | 3p21.3 | colon cancer |
| Familial diffuse-type gastric cancer | CDH1 | 658-661 | 5206-5209 | cell-cell adhesion protein | 16q22.1 | gastric cancer, lobular breast cancer |
| von Hippel-Lindau Syndrome | VHL | 4486-4488 | 9023-9025 | regulation of transcription elongation through activation of a ubiquitin ligase complex | 3p26-p25 | renal cancers, hemangioblastomas, pheochromocytoma, retinal angioma |
| Familial Melanoma | CDKN2A | 704-723 | 5252-5271 | p16INK4 inhibits cell-cycle kinases CDK4 and CDK6; p14ARF binds the p53 stabilizing protein MDM2 | 9p21 | melanoma, pancreatic cancer, others |

TABLE 7-continued

Familial Cancer Syndrome Targets

| Familial Cancer Syndrome | Tumor Suppressor Gene | ENST SEQ ID | ENSP SEQ ID | Function | Chromosomal Location | Tumor Types Observed |
|---|---|---|---|---|---|---|
| Gorlin Syndrome: Nevoid basal cell carcinoma syndrome (NBCCS) | PTCH (e.g., PTCH1, PTCH2) | 3000-3016 | 7547-7553 | transmembrane receptor for sonic hedgehog (shh), involved in early development through repression of action of smoothened | 9q22.3 | basal cell skin carcinoma |
| Multiple Endocrine Neoplasia Type 1 | MEN1 | 2570-2584 | 7107-7121 | intrastrand DNA crosslink repair | 11q13 | parathyroid and pituitary adenomas, islet cell tumors, carcinoid |

Protein Cleavage Signals and Sites

In one embodiment, the oncology-related polypeptides of the present invention may include at least one protein cleavage signal containing at least one protein cleavage site. The protein cleavage site may be located at the N-terminus, the C-terminus, at any space between the N- and the C-termini such as, but not limited to, half-way between the N- and C-termini, between the N-terminus and the half way point, between the half way point and the C-terminus, and combinations thereof.

The oncology-related polypeptides of the present invention may include, but is not limited to, a proprotein convertase (or prohormone convertase), thrombin or Factor Xa protein cleavage signal. Proprotein convertases are a family of nine proteinases, comprising seven basic amino acid-specific subtilisin-like serine proteinases related to yeast kexin, known as prohormone convertase 1/3 (PC1/3), PC2, furin, PC4, PC5/6, paired basic amino-acid cleaving enzyme 4 (PACE4) and PC7, and two other subtilases that cleave at non-basic residues, called subtilisin kexin isozyme 1 (SKI-1) and proprotein convertase subtilisin kexin 9 (PCSK9). Non-limiting examples of protein cleavage signal amino acid sequences are listing in Table 8. In Table 8, "X" refers to any amino acid, "n" may be 0, 2, 4 or 6 amino acids and "*" refers to the protein cleavage site. In Table 8, SEQ ID NO: 33885 refers to when n=4 and SEQ ID NO: 33886 refers to when n=6.

TABLE 8

Protein Cleavage Site Sequences

| Protein Cleavage Signal | Amino Acid Cleavage Sequence | SEQ ID NO |
|---|---|---|
| Proprotein convertase | R-X-X-R* | 33883 |
| | R-X-K/R-R* | 33884 |
| | K/R-Xn-K/R* | 33885 or 33886 |
| Thrombin | L-V-P-R*-G-S | 33887 |
| | L-V-P-R* | 33888 |
| | A/F/G/I/L/T/V/M-A/F/G/I/L/T/V/W-P-R* | 33889 |
| Factor Xa | I-E-G-R* | 33890 |
| | I-D-G-R* | 33891 |
| | A-E-G-R* | 33892 |
| | A/F/G/I/L/T/V/M-D/E-G-R* | 33893 |

In one embodiment, the oncology-related primary constructs and the oncology-related mmRNA of the present invention may be engineered such that the oncology-related primary construct or oncology-related mmRNA contains at least one encoded protein cleavage signal. The encoded protein cleavage signal may be located before the start codon, after the start codon, before the coding region, within the coding region such as, but not limited to, half way in the coding region, between the start codon and the half way point, between the half way point and the stop codon, after the coding region, before the stop codon, between two stop codons, after the stop codon and combinations thereof.

In one embodiment, the oncology-related primary constructs or oncology-related mmRNA of the present invention may include at least one encoded protein cleavage signal containing at least one protein cleavage site. The encoded protein cleavage signal may include, but is not limited to, a proprotein convertase (or prohormone convertase), thrombin and/or Factor Xa protein cleavage signal. One of skill in the art may use Table 1 above or other known methods to determine the appropriate encoded protein cleavage signal to include in the oncology-related primary constructs or mmRNA of the present invention. For example, starting with the signal of Table 8 and considering the codons of Table 1 one can design a signal for the oncology-related primary construct which can produce a protein signal in the resulting oncology-related polypeptide.

In one embodiment, the oncology-related polypeptides of the present invention include at least one protein cleavage signal and/or site.

As a non-limiting example, U.S. Pat. No. 7,374,930 and U.S. Pub. No. 20090227660, herein incorporated by reference in their entireties, use a furin cleavage site to cleave the N-terminal methionine of GLP-1 in the expression product from the Golgi apparatus of the cells. In one embodiment, the polypeptides of the present invention include at least one protein cleavage signal and/or site with the proviso that the polypeptide is not GLP-1.

In one embodiment, the oncology-related primary constructs or oncology-related mmRNA of the present invention includes at least one encoded protein cleavage signal and/or site.

In one embodiment, the oncology-related primary constructs or oncology-related mmRNA of the present invention includes at least one encoded protein cleavage signal and/or site with the proviso that the oncology-related primary construct or oncology-related mmRNA does not encode GLP-1.

In one embodiment, the oncology-related primary constructs or oncology-related mmRNA of the present invention may include more than one coding region. Where multiple coding regions are present in the oncology-related primary construct or oncology-related mmRNA of the present invention, the multiple coding regions may be separated by encoded protein cleavage sites. As a non-limiting example, the oncology-related primary construct or oncology-related mmRNA may be signed in an ordered pattern. On such pattern follows AXBY form where A and B are coding regions which may be the same or different coding regions and/or may encode the same or different oncology-related polypeptides, and X and Y are encoded protein cleavage signals which may encode the same or different protein cleavage signals. A second such pattern follows the form AXYBZ where A and B are coding regions which may be the same or different coding regions and/or may encode the same or different oncology-related polypeptides, and X, Y and Z are encoded protein cleavage signals which may encode the same or different protein cleavage signals. A third pattern follows the form ABXCY where A, B and C are coding regions which may be the same or different coding regions and/or may encode the same or different oncology-related polypeptides, and X and Y are encoded protein cleavage signals which may encode the same or different protein cleavage signals.

In one embodiment, the oncology-related polypeptides, oncology-related primary constructs and oncology-related mmRNA can also contain sequences that encode protein cleavage sites so that the oncology-related polypeptides, oncology-related primary constructs and oncology-related mmRNA can be released from a carrier region or a fusion partner by treatment with a specific protease for said protein cleavage site.

In one embodiment, the oncology-related polypeptides, primary constructs and mmRNA of the present invention may include a sequence encoding the 2A peptide. In one embodiment, this sequence may be used to separate the coding region of two or more polypeptides of interest. As a non-limiting example, the sequence encoding the 2A peptide may be between coding region A and coding region B (A-2Apep-B). The presence of the 2A peptide would result in the cleavage of one long protein into protein A, protein B and the 2A peptide. Protein A and protein B may be the same or different polypeptides of interest. In another embodiment, the 2A peptide may be used in the oncology-related polynucleotides, primary constructs and/or mmRNA of the present invention to produce two, three, four, five, six, seven, eight, nine, ten or more proteins.

Incorporating Post Transcriptional Control Modulators

In one embodiment, the oncology-related polynucleotides, primary constructs and/or mmRNA of the present invention may include at least one post transcriptional control modulator. These post transcriptional control modulators may be, but are not limited to, small molecules, compounds and regulatory sequences. As a non-limiting example, post transcriptional control may be achieved using small molecules identified by PTC Therapeutics Inc. (South Plainfield, N.J.) using their GEMS' (Gene Expression Modulation by Small-Moleclues) screening technology.

The post transcriptional control modulator may be a gene expression modulator which is screened by the method detailed in or a gene expression modulator described in International Publication No. WO2006022712, herein incorporated by reference in its entirety. Methods identifying RNA regulatory sequences involved in translational control are described in International Publication No. WO2004067728, herein incorporated by reference in its entirety; methods identifying compounds that modulate untranslated region dependent expression of a gene are described in International Publication No. WO2004065561, herein incorporated by reference in its entirety.

In one embodiment, the oncology-related polynucleotides, primary constructs and/or mmRNA of the present invention may include at least one post transcriptional control modulator is located in the 5' and/or the 3' untranslated region of the polynucleotides, primary constructs and/or mmRNA of the present invention In another embodiment, the oncology-related polynucleotides, primary constructs and/or mmRNA of the present invention may include at least one post transcription control modulator to modulate premature translation termination. The post transcription control modulators may be compounds described in or a compound found by methods outlined in International Publication Nso. WO2004010106, WO2006044456, WO2006044682, WO2006044503 and WO2006044505, each of which is herein incorporated by reference in its entirety. As a non-limiting example, the compound may bind to a region of the 28S ribosomal RNA in order to modulate premature translation termination (See e.g., WO2004010106, herein incorporated by reference in its entirety).

In one embodiment, the oncology-related polynucleotides, primary constructs and/or mmRNA of the present invention may include at least one post transcription control modulator to alter protein expression. As a non-limiting example, the expression of VEGF may be regulated using the compounds described in or a compound found by the methods described in International Publication Nos. WO2005118857, WO2006065480, WO2006065479 and WO2006058088, each of which is herein incorporated by reference in its entirety.

The oncology-related polynucleotides, primary constructs and/or mmRNA of the present invention may include at least one post transcription control modulator to control translation. In one embodiment, the post transcription control modulator may be a RNA regulatory sequence. As a non-limiting example, the RNA regulatory sequence may be identified by the methods described in International Publication No. WO2006071903, herein incorporated by reference in its entirety.

III. MODIFICATIONS

Herein, in an oncology-related polynucleotide (such as an oncology-related primary construct or an oncology-related mRNA molecule), the terms "modification" or, as appropriate, "modified" refer to modification with respect to A, G, U or C ribonucleotides. Generally, herein, these terms are not intended to refer to the ribonucleotide modifications in naturally occurring 5'-terminal mRNA cap moieties. In a polypeptide, the term "modification" refers to a modification as compared to the canonical set of 20 amino acids, moiety)

The modifications may be various distinct modifications. In some embodiments, the coding region, the flanking regions and/or the terminal regions may contain one, two, or more (optionally different) nucleoside or nucleotide modifications. In some embodiments, a modified oncology-related polynucleotide, oncology-related primary construct, or oncology-related mmRNA introduced to a cell may exhibit reduced degradation in the cell, as compared to an unmodified oncology-related polynucleotide, oncology-related primary construct, or oncology-related mmRNA.

The oncology-related polynucleotides, oncology-related primary constructs, and oncology-related mmRNA can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof). Additional modifications are described herein.

As described herein, the oncology-related polynucleotides, oncology-related primary constructs, and oncology-related mmRNA of the invention do not substantially induce an innate immune response of a cell into which the mRNA is introduced. Features of an induced innate immune response include 1) increased expression of pro-inflammatory cytokines, 2) activation of intracellular PRRs (RIG-I, MDA5, etc, and/or 3) termination or reduction in protein translation.

In certain embodiments, it may be desirable to intracellularly degrade a modified nucleic acid molecule introduced into the cell. For example, degradation of a modified oncology-related nucleic acid molecule may be preferable if precise timing of protein production is desired. Thus, in some embodiments, the invention provides a modified oncology-related nucleic acid molecule containing a degradation domain, which is capable of being acted on in a directed manner within a cell. In another aspect, the present disclosure provides oncology-related polynucleotides comprising a nucleoside or nucleotide that can disrupt the binding of a major groove interacting, e.g. binding, partner with the polynucleotide (e.g., where the modified nucleotide has decreased binding affinity to major groove interacting partner, as compared to an unmodified nucleotide).

The oncology-related polynucleotides, oncology-related primary constructs, and oncology-related mmRNA can optionally include other agents (e.g., RNAi-inducing agents, RNAi agents, siRNAs, shRNAs, miRNAs, antisense RNAs, ribozymes, catalytic DNA, tRNA, RNAs that induce triple helix formation, aptamers, vectors, etc.). In some embodiments, the oncology-related polynucleotides, oncology-related primary constructs, or oncology-related mmRNA may include one or more messenger RNAs (mRNAs) and one or more modified nucleoside or nucleotides (e.g., mmRNA molecules). Details for these oncology-related polynucleotides, oncology-related primary constructs, and oncology-related mmRNA follow.

Oncology-Related Polynucleotides and Oncology-Related Primary Constructs

The oncology-related polynucleotides, primary constructs, and mmRNA of the invention includes a first region of linked nucleosides encoding a polypeptide of interest, a first flanking region located at the 5' terminus of the first region, and a second flanking region located at the 3' terminus of the first region.

In some embodiments, the oncology-related polynucleotide, primary construct, or mmRNA (e.g., the first region, first flanking region, or second flanking region) includes n number of linked nucleosides having Formula (Ia) or Formula (Ia-1):

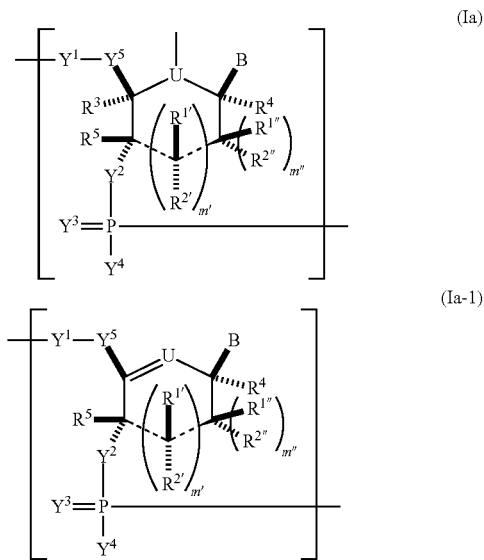

or a pharmaceutically acceptable salt or stereoisomer thereof, wherein

U is O, S, N($R^U$)$_{nu}$, or C($R^U$)$_{nu}$, wherein nu is an integer from 0 to 2 and each $R^U$ is, independently, H, halo, or optionally substituted alkyl;

- - - is a single bond or absent;

each of $R^{1'}$, $R^{2'}$, $R^{1''}$, $R^{2''}$, $R^1$, $R^2$, $R^3$, $R^4$, and $R^5$ is, independently, if present, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, optionally substituted aminoalkynyl, or absent; wherein the combination of $R^3$ with one or more of $R^{1'}$, $R^{1''}$, $R^{2'}$, $R^{2''}$, or $R^5$ (e.g., the combination of $R^{1'}$ and $R^3$, the combination of $R^{1''}$ and $R^3$, the combination of $R^{2'}$ and $R^3$, the combination of $R^{2''}$ and $R^3$, or the combination of $R^5$ and $R^3$) can join together to form optionally substituted alkylene or optionally substituted heteroalkylene and, taken together with the carbons to which they are attached, provide an optionally substituted heterocyclyl (e.g., a bicyclic, tricyclic, or tetracyclic heterocyclyl); wherein the combination of $R^5$ with one or more of $R^{1'}$, $R^{1''}$, $R^{2'}$, or $R^{2''}$ (e.g., the combination of $R^{1'}$ and $R^5$, the combination of $R^{1''}$ and $R^5$, the combination of $R^{2'}$ and $R^5$, or the combination of $R^{2''}$ and $R^5$) can join together to form optionally substituted alkylene or optionally substituted heteroalkylene and, taken together with the carbons to which they are attached, provide an optionally substituted heterocyclyl (e.g., a bicyclic, tricyclic, or tetracyclic heterocyclyl); and wherein the combination of $R^4$ and one or more of $R^{1'}$, $R^{1''}$, $R^{2'}$, $R^{2''}$, $R^3$, or $R^5$ can join together to form optionally substituted alkylene or optionally substituted heteroalkylene and, taken together with the carbons to which they are attached, provide an optionally substituted heterocyclyl (e.g., a bicyclic, tricyclic, or tetracyclic heterocyclyl);

each of m' and m'' is, independently, an integer from 0 to 3 (e.g., from 0 to 2, from 0 to 1, from 1 to 3, or from 1 to 2);

each of $Y^1$, $Y^2$, and $Y^3$, is, independently, O, S, Se, —$NR^{N1}$—, optionally substituted alkylene, or optionally substituted heteroalkylene, wherein $R^{N1}$ is H, optionally substituted alkyl, optionally substituted alkenyl, optionally substituted alkynyl, optionally substituted aryl, or absent;

each $Y^4$ is, independently, H, hydroxy, thiol, boranyl, optionally substituted alkyl, optionally substituted alkenyl, optionally substituted alkynyl, optionally substituted alkoxy, optionally substituted alkenyloxy, optionally substituted alkynyloxy, optionally substituted thioalkoxy, optionally substituted alkoxyalkoxy, or optionally substituted amino;

each $Y^5$ is, independently, O, S, Se, optionally substituted alkylene (e.g., methylene), or optionally substituted heteroalkylene;

n is an integer from 1 to 100,000; and

B is a nucleobase (e.g., a purine, a pyrimidine, or derivatives thereof), wherein the combination of B and $R^{1'}$, the combination of B and $R^{2'}$, the combination of B and $R^{1''}$, or the combination of B and $R^{2''}$ can, taken together with the carbons to which they are attached, optionally form a bicyclic group (e.g., a bicyclic heterocyclyl) or wherein the combination of B, $R^{1''}$, and $R^3$ or the combination of B, $R^{2''}$, and $R^3$ can optionally form a tricyclic or tetracyclic group (e.g., a tricyclic or tetracyclic heterocyclyl, such as in Formula (IIo)-(IIp) herein). In some embodiments, the oncology-related polynucleotide, primary construct, or mmRNA includes a modified ribose. In some embodiments, the oncology-related polynucleotide, primary construct, or mmRNA (e.g., the first region, the first flanking region, or the second flanking region) includes n number of linked nucleosides having Formula (Ia-2)-(Ia-5) or a pharmaceutically acceptable salt or stereoisomer thereof.

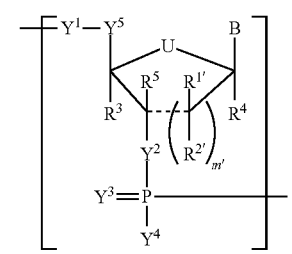
(Ia-2)

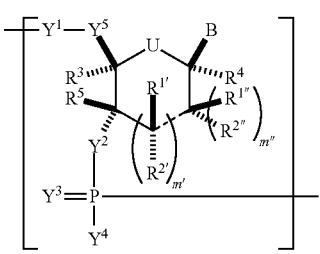
(Ia-3)

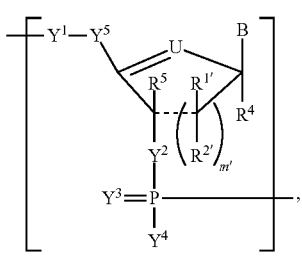
(Ia-4)

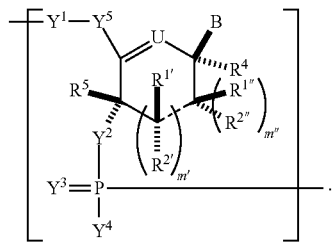
(Ia-5)

In some embodiments, the oncology-related polynucleotide, primary construct, or mmRNA (e.g., the first region, the first flanking region, or the second flanking region) includes n number of linked nucleosides having Formula (Ib) or Formula (Ib-1):

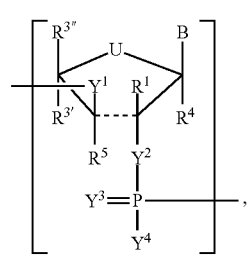
(Ib)

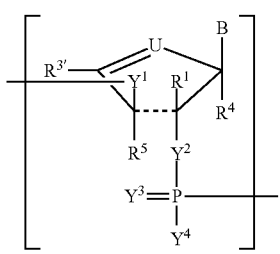
(Ib-1)

or a pharmaceutically acceptable salt or stereoisomer thereof, wherein

U is O, S, $N(R^U)_{nu}$, or $C(R^U)_{nu}$, wherein nu is an integer from 0 to 2 and each $R^U$ is, independently, H, halo, or optionally substituted alkyl;

- - - is a single bond or absent;

each of $R^1$, $R^{3'}$, $R^{3''}$, and $R^4$ is, independently, H, halo, hydroxy, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, optionally substituted aminoalkynyl, or absent; and wherein the combination of $R^1$ and $R^{3'}$ or the combination of $R^1$ and $R^{3''}$ can be taken together to form optionally substituted alkylene or optionally substituted heteroalkylene (e.g., to produce a locked nucleic acid);

each $R^5$ is, independently, H, halo, hydroxy, optionally substituted alkyl, optionally substituted alkoxy, optionally substituted alkenyloxy, optionally substituted alkynyloxy, optionally substituted aminoalkoxy, optionally substituted alkoxyalkoxy, or absent;

each of $Y^1$, $Y^2$, and $Y^3$ is, independently, O, S, Se, —$NR^{N1}$—, optionally substituted alkylene, or optionally substituted heteroalkylene, wherein $R^{N1}$ is H, optionally substituted alkyl, optionally substituted alkenyl, optionally substituted alkynyl, or optionally substituted aryl;

each $Y^4$ is, independently, H, hydroxy, thiol, boranyl, optionally substituted alkyl, optionally substituted alkenyl, optionally substituted alkynyl, optionally substituted alkoxy, optionally substituted alkenyloxy, optionally substituted alkynyloxy, optionally substituted alkoxyalkoxy, or optionally substituted amino;

n is an integer from 1 to 100,000; and

B is a nucleobase.

In some embodiments, the oncology-related polynucleotide, primary construct, or mmRNA (e.g., the first region, first flanking region, or second flanking region) includes n number of linked nucleosides having Formula (Ic):

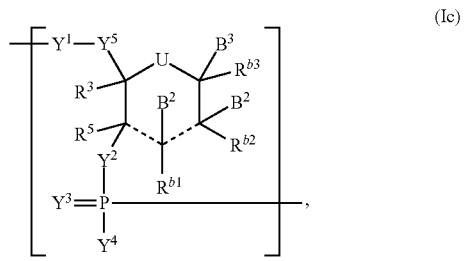

(Ic)

or a pharmaceutically acceptable salt or stereoisomer thereof, wherein

U is O, S, N($R^U$)$_{nu}$, or C($R^U$)$_{nu}$, wherein nu is an integer from 0 to 2 and each $R^U$ is, independently, H, halo, or optionally substituted alkyl;

- - - is a single bond or absent;

each of $B^1$, $B^2$, and $B^3$ is, independently, a nucleobase (e.g., a purine, a pyrimidine, or derivatives thereof, as described herein), H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, or optionally substituted aminoalkynyl, wherein one and only one of $B^1$, $B^2$, and $B^3$ is a nucleobase;

each of $R^{b1}$, $R^{b2}$, $R^{b3}$, $R^3$, and $R^5$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl or optionally substituted aminoalkynyl;

each of $Y^1$, $Y^2$, and $Y^3$, is, independently, O, S, Se, —$NR^{N1}$—, optionally substituted alkylene, or optionally substituted heteroalkylene, wherein $R^{N1}$ is H, optionally substituted alkyl, optionally substituted alkenyl, optionally substituted alkynyl, or optionally substituted aryl;

each $Y^4$ is, independently, H, hydroxy, thiol, boranyl, optionally substituted alkyl, optionally substituted alkenyl, optionally substituted alkynyl, optionally substituted alkoxy, optionally substituted alkenyloxy, optionally substituted alkynyloxy, optionally substituted thioalkoxy, optionally substituted alkoxyalkoxy, or optionally substituted amino;

each $Y^5$ is, independently, O, S, Se, optionally substituted alkylene (e.g., methylene), or optionally substituted heteroalkylene;

n is an integer from 1 to 100,000; and wherein the ring including U can include one or more double bonds.

In particular embodiments, the ring including U does not have a double bond between U—$CB^3R^{b3}$ or between $CB^3R^{b3}$—$C^{B2}R^{b2}$.

In some embodiments, the oncology-related polynucleotide, primary construct, or mmRNA (e.g., the first region, first flanking region, or second flanking region) includes n number of linked nucleosides having Formula (Id):

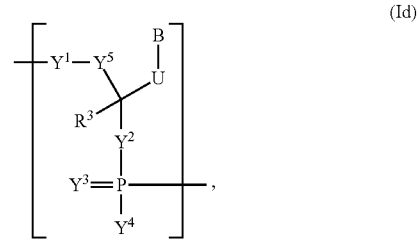

(Id)

or a pharmaceutically acceptable salt or stereoisomer thereof, wherein

U is O, S, N($R^U$)$_{nu}$, or C($R^U$)$_{nu}$, wherein nu is an integer from 0 to 2 and each $R^U$ is, independently, H, halo, or optionally substituted alkyl;

each $R^3$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, or optionally substituted aminoalkynyl;

each of $Y^1$, $Y^2$, and $Y^3$, is, independently, O, S, Se, —$NR^{N1}$—, optionally substituted alkylene, or optionally substituted heteroalkylene, wherein $R^{N1}$ is H, optionally substituted alkyl, optionally substituted alkenyl, optionally substituted alkynyl, or optionally substituted aryl;

each $Y^4$ is, independently, H, hydroxy, thiol, boranyl, optionally substituted alkyl, optionally substituted alkenyl, optionally substituted alkynyl, optionally substituted alkoxy, optionally substituted alkenyloxy, optionally substituted alkynyloxy, optionally substituted thioalkoxy, optionally substituted alkoxyalkoxy, or optionally substituted amino;

each $Y^5$ is, independently, O, S, optionally substituted alkylene (e.g., methylene), or optionally substituted heteroalkylene;

n is an integer from 1 to 100,000; and

B is a nucleobase (e.g., a purine, a pyrimidine, or derivatives thereof).

In some embodiments, the oncology-related polynucleotide, primary construct, or mmRNA (e.g., the first region, first flanking region, or second flanking region) includes n number of linked nucleosides having Formula (Ie):

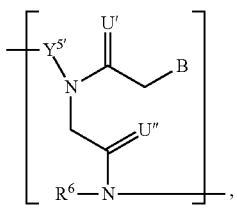

(Ie)

or a pharmaceutically acceptable salt or stereoisomer thereof, wherein each of U' and U''' is, independently, O, S, N(R$^U$)$_{nu}$, or C(R$^U$)$_{nu}$, wherein nu is an integer from 0 to 2 and each R$^U$ is, independently, H, halo, or optionally substituted alkyl;

each R$^6$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, or optionally substituted aminoalkynyl;

each Y$^{5'}$ is, independently, O, S, optionally substituted alkylene (e.g., methylene or ethylene), or optionally substituted heteroalkylene;

n is an integer from 1 to 100,000; and

B is a nucleobase (e.g., a purine, a pyrimidine, or derivatives thereof).

In some embodiments, the oncology-related polynucleotide, primary construct, or mmRNA (e.g., the first region, first flanking region, or second flanking region) includes n number of linked nucleosides having Formula (If) or (If-1):

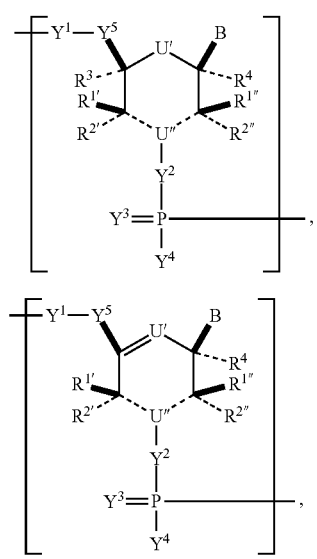

or a pharmaceutically acceptable salt or stereoisomer thereof, wherein each of U' and U''' is, independently, O, S, N, N(R$^U$)$_{nu}$, or C(R$^U$)$_{nu}$, wherein nu is an integer from 0 to 2 and each R$^U$ is, independently, H, halo, or optionally substituted alkyl (e.g., U' is O and U''' is N);

- - - is a single bond or absent;

each of R$^{1'}$, R$^{2'}$, R$^{1'''}$, R$^{2'''}$, R$^3$, and R$^4$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, optionally substituted aminoalkynyl, or absent; and wherein the combination of R$^{1'}$ and R$^3$, the combination of R$^{1'''}$ and R$^3$, the combination of R$^{2'}$ and R$^3$, or the combination of R$^{2'''}$ and R$^3$ can be taken together to form optionally substituted alkylene or optionally substituted heteroalkylene (e.g., to produce a locked nucleic acid); each of m' and m''' is, independently, an integer from 0 to 3 (e.g., from 0 to 2, from 0 to 1, from 1 to 3, or from 1 to 2);

each of Y$^1$, Y$^2$, and Y$^3$, is, independently, O, S, Se, —NR$^{N1}$—, optionally substituted alkylene, or optionally substituted heteroalkylene, wherein R$^{N1}$ is H, optionally substituted alkyl, optionally substituted alkenyl, optionally substituted alkynyl, optionally substituted aryl, or absent;

each Y$^4$ is, independently, H, hydroxy, thiol, boranyl, optionally substituted alkyl, optionally substituted alkenyl, optionally substituted alkynyl, optionally substituted alkoxy, optionally substituted alkenyloxy, optionally substituted alkynyloxy, optionally substituted thioalkoxy, optionally substituted alkoxyalkoxy, or optionally substituted amino;

each Y$^5$ is, independently, O, S, Se, optionally substituted alkylene (e.g., methylene), or optionally substituted heteroalkylene;

n is an integer from 1 to 100,000; and

B is a nucleobase (e.g., a purine, a pyrimidine, or derivatives thereof).

In some embodiments of the oncology-related polynucleotides, primary constructs, or mmRNA (e.g., Formulas (Ia), (Ia-1)-(Ia-3), (Ib)-(If), and (IIa)-(IIp)), the ring including U has one or two double bonds.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), each of R$^1$, R$^{1'}$, and R$^{1'''}$, if present, is H. In further embodiments, each of R$^2$, R$^{2'}$, and R$^{2'''}$, if present, is, independently, H, halo (e.g., fluoro), hydroxy, optionally substituted alkoxy (e.g., methoxy or ethoxy), or optionally substituted alkoxyalkoxy. In particular embodiments, alkoxyalkoxy is —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or C$_{1-20}$ alkyl). In some embodiments, s2 is 0, s1 is 1 or 2, s3 is 0 or 1, and R' is C$_{1-6}$ alkyl.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), each of R$^2$, R$^{2'}$, and R$^{2'''}$, if present, is H. In further embodiments, each of R$^1$, R$^{1'}$, and R$^{1'''}$, if present, is, independently, H, halo (e.g., fluoro), hydroxy, optionally substituted alkoxy (e.g., methoxy or ethoxy), or optionally substituted alkoxyalkoxy. In particular embodiments, alkoxyalkoxy is —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or C$_{1-20}$ alkyl). In some embodiments, s2 is 0, s1 is 1 or 2, s3 is 0 or 1, and R' is C$_{1-6}$ alkyl.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), each of $R^3$, $R^4$, and $R^5$ is, independently, H, halo (e.g., fluoro), hydroxy, optionally substituted alkyl, optionally substituted alkoxy (e.g., methoxy or ethoxy), or optionally substituted alkoxyalkoxy. In particular embodiments, $R^3$ is H, $R^4$ is H, $R^5$ is H, or $R^3$, $R^4$, and $R^5$ are all H. In particular embodiments, $R^3$ is $C_{1-6}$ alkyl, $R^4$ is $C_{1-6}$ alkyl, $R^5$ is $C_{1-6}$ alkyl, or $R^3$, $R^4$, and $R^5$ are all $C_{1-6}$ alkyl. In particular embodiments, $R^3$ and $R^4$ are both H, and $R^5$ is $C_{1-6}$ alkyl.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), $R^3$ and $R^5$ join together to form optionally substituted alkylene or optionally substituted heteroalkylene and, taken together with the carbons to which they are attached, provide an optionally substituted heterocyclyl (e.g., a bicyclic, tricyclic, or tetracyclic heterocyclyl, such as trans-3',4' analogs, wherein $R^3$ and $R^5$ join together to form heteroalkylene (e.g., $-(CH_2)_{b1}O(CH_2)_{b2}O(CH_2)_{b3}-$, wherein each of b1, b2, and b3 are, independently, an integer from 0 to 3).

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), $R^3$ and one or more of $R^{1'}$, $R^{1''}$, $R^{2'}$, $R^{2''}$, or $R^5$ join together to form optionally substituted alkylene or optionally substituted heteroalkylene and, taken together with the carbons to which they are attached, provide an optionally substituted heterocyclyl (e.g., a bicyclic, tricyclic, or tetracyclic heterocyclyl, $R^3$ and one or more of $R^{1'}$, $R^{1''}$, $R^{2'}$, $R^{2''}$, or $R^5$ join together to form heteroalkylene (e.g., $-(CH_2)_{b1}O(CH_2)_{b2}O(CH_2)_{b3}-$, wherein each of b1, b2, and b3 are, independently, an integer from 0 to 3).

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), $R^5$ and one or more of $R^{1'}$, $R^{1''}$, $R^{2'}$, or $R^{2''}$ join together to form optionally substituted alkylene or optionally substituted heteroalkylene and, taken together with the carbons to which they are attached, provide an optionally substituted heterocyclyl (e.g., a bicyclic, tricyclic, or tetracyclic heterocyclyl, $R^5$ and one or more of $R^{1'}$, $R^{1''}$, $R^{2'}$, or $R^{2''}$ join together to form heteroalkylene (e.g., $-(CH_2)_{b1}O(CH_2)_{b2}O(CH_2)_{b3}-$, wherein each of b1, b2, and b3 are, independently, an integer from 0 to 3).

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), each $Y^2$ is, independently, O, S, or $-NR^{N1}-$, wherein $R^{N1}$ is H, optionally substituted alkyl, optionally substituted alkenyl, optionally substituted alkynyl, or optionally substituted aryl. In particular embodiments, $Y^2$ is $NR^{N1}-$, wherein $R^{N1}$ is H or optionally substituted alkyl (e.g., $C_{1-6}$ alkyl, such as methyl, ethyl, isopropyl, or n-propyl).

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), each $Y^3$ is, independently, O or S.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), $R^1$ is H; each $R^2$ is, independently, H, halo (e.g., fluoro), hydroxy, optionally substituted alkoxy (e.g., methoxy or ethoxy), or optionally substituted alkoxyalkoxy (e.g., $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, such as wherein s2 is 0, s1 is 1 or 2, s3 is 0 or 1, and R' is $C_{1-6}$ alkyl); each $Y^2$ is, independently, O or $-NR^{N1}-$, wherein $R^{N1}$ is H, optionally substituted alkyl, optionally substituted alkenyl, optionally substituted alkynyl, or optionally substituted aryl (e.g., wherein $R^{N1}$ is H or optionally substituted alkyl (e.g., $C_{1-6}$ alkyl, such as methyl, ethyl, isopropyl, or n-propyl)); and each $Y^3$ is, independently, O or S (e.g., S). In further embodiments, $R^3$ is H, halo (e.g., fluoro), hydroxy, optionally substituted alkyl, optionally substituted alkoxy (e.g., methoxy or ethoxy), or optionally substituted alkoxyalkoxy. In yet further embodiments, each $Y^1$ is, independently, O or $-NR^{N1}-$, wherein $R^{N1}$ is H, optionally substituted alkyl, optionally substituted alkenyl, optionally substituted alkynyl, or optionally substituted aryl (e.g., wherein $R^{N1}$ is H or optionally substituted alkyl (e.g., $C_{1-6}$ alkyl, such as methyl, ethyl, isopropyl, or n-propyl)); and each $Y^4$ is, independently, H, hydroxy, thiol, optionally substituted alkyl, optionally substituted alkoxy, optionally substituted thioalkoxy, optionally substituted alkoxyalkoxy, or optionally substituted amino.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), each $R^1$ is, independently, H, halo (e.g., fluoro), hydroxy, optionally substituted alkoxy (e.g., methoxy or ethoxy), or optionally substituted alkoxyalkoxy (e.g., $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, such as wherein s2 is 0, s1 is 1 or 2, s3 is 0 or 1, and R' is $C_{1-6}$ alkyl); $R^2$ is H; each $Y^2$ is, independently, O or $-NR^{N1}-$, wherein $R^{N1}$ is H, optionally substituted alkyl, optionally substituted alkenyl, optionally substituted alkynyl, or optionally substituted aryl (e.g., wherein $R^{N1}$ is H or optionally substituted alkyl (e.g., $C_{1-6}$ alkyl, such as methyl, ethyl, isopropyl, or n-propyl)); and each $Y^3$ is, independently, O or S (e.g., S). In further embodiments, $R^3$ is H, halo (e.g., fluoro), hydroxy, optionally substituted alkyl, optionally substituted alkoxy (e.g., methoxy or ethoxy), or optionally substituted alkoxyalkoxy. In yet further embodiments, each $Y^1$ is, independently, O or $-NR^{N1}-$, wherein $R^{N1}$ is H, optionally substituted alkyl, optionally substituted alkenyl, optionally substituted alkynyl, or optionally substituted aryl (e.g., wherein $R^{N1}$ is H or optionally substituted alkyl (e.g., $C_{1-6}$ alkyl, such as methyl, ethyl, isopropyl, or n-propyl)); and each $Y^4$ is, independently, H, hydroxy, thiol, optionally substituted alkyl, optionally substituted alkoxy, optionally substituted thioalkoxy, optionally substituted alkoxyalkoxy, or optionally substituted amino.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), the ring including U is in the β-D (e.g., β-D-ribo) configuration.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), the ring including U is in the α-L (e.g., α-L-ribo) configuration.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), one or more B is not pseudouridine (ψ) or 5-methyl-cytidine ($m^5C$). In some embodiments, about 10% to about 100% of n number of B nucleobases is not ψ or $m^5C$ (e.g., from 10% to 20%, from 10% to 35%, from 10% to 50%, from 10% to 60%, from 10% to 75%, from 10% to 90%, from 10% to 95%, from 10% to 98%, from 10% to 99%, from 20% to 35%, from 20% to 50%, from 20% to 60%, from 20% to 75%, from 20% to 90%, from 20% to 95%, from 20% to 98%, from 20% to 99%, from 20% to 100%, from 50% to 60%, from 50% to 75%, from 50% to 90%, from 50% to 95%, from 50% to 98%, from 50% to 99%, from 50% to 100%, from 75% to 90%, from 75% to 95%, from 75% to 98%, from 75% to 99%, and from 75% to 100% of n number of B is not ψ or $m^5C$). In some embodiments, B is not ψ or $m^5C$.

In some embodiments of the oncology-related polynucleotides, primary constructs, or mmRNA (e.g., Formulas (Ia)-(Ia-5), (Ib)-(If-1), (IIa)-(IIp), (IIb-1), (IIb-2), (IIc-1)-(IIc-2), (IIn-1), (IIn-2), (IVa)-(IVl), and (IXa)-(IXr)), when B is an unmodified nucleobase selected from cytosine, guanine, uracil and adenine, then at least one of $Y^1$, $Y^2$, or $Y^3$ is not O.

In some embodiments, the oncology-related polynucleotide, primary construct, or mmRNA includes a modified ribose. In some embodiments, the oncology-related polynucleotide, primary construct, or mmRNA (e.g., the first region, the first flanking region, or the second flanking region) includes n number of linked nucleosides having Formula (IIa)-(IIc):

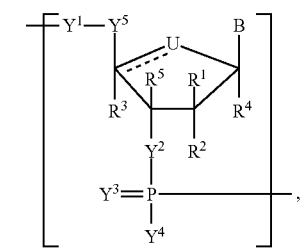

(IIa)

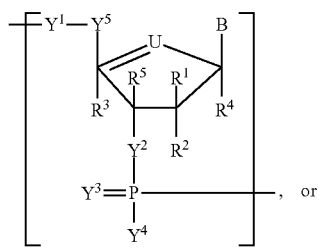

(IIb)

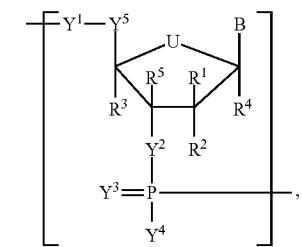

(IIc)

or a pharmaceutically acceptable salt or stereoisomer thereof. In particular embodiments, U is O or $C(R^U)_{nu}$, wherein nu is an integer from 0 to 2 and each $R^U$ is, independently, H, halo, or optionally substituted alkyl (e.g., U is —$CH_2$— or —CH—). In other embodiments, each of $R^1$, $R^2$, $R^3$, $R^4$, and $R^5$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, optionally substituted aminoalkynyl, or absent (e.g., each $R^1$ and $R^2$ is, independently, H, halo, hydroxy, optionally substituted alkyl, or optionally substituted alkoxy; each $R^3$ and $R^4$ is, independently, H or optionally substituted alkyl; and $R^5$ is H or hydroxy), and --- is a single bond or double bond. In particular embodiments, the polynucleotide- or mmRNA includes n number of linked nucleosides having Formula (IIb-1)-(IIb-2):

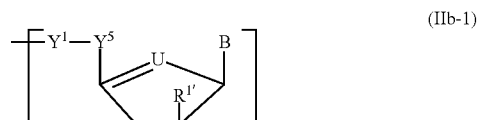

(IIb-1)

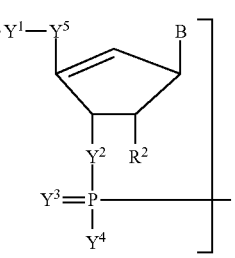

(IIb-2)

or a pharmaceutically acceptable salt or stereoisomer thereof. In some embodiments, U is O or $C(R^U)_{nu}$, wherein nu is an integer from 0 to 2 and each $R^U$ is, independently, H, halo, or optionally substituted alkyl (e.g., U is —$CH_2$— or —CH—). In other embodiments, each of $R^1$ and $R^2$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, optionally substituted aminoalkynyl, or absent (e.g., each $R^1$ and $R^2$ is, independently, H, halo, hydroxy, optionally substituted alkyl, or optionally substituted alkoxy, e.g., H, halo, hydroxy, alkyl, or alkoxy). In particular embodiments, $R^2$ is hydroxy or optionally substituted alkoxy (e.g., methoxy, ethoxy, or any described herein).

In particular embodiments, the oncology-related polynucleotide, primary construct, or mmRNA includes n number of linked nucleosides having Formula (IIc-1)-(IIc-4):

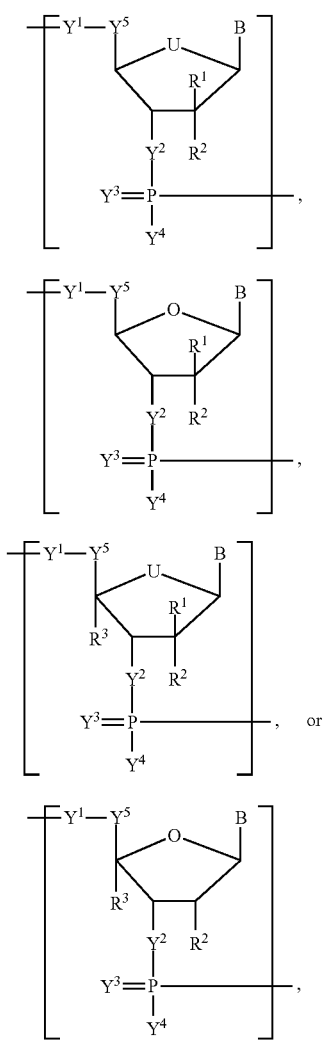

(IIc-1)

(IIc-2)

(IIc-3)

(IIc-4)

or a pharmaceutically acceptable salt or stereoisomer thereof. In some embodiments, U is O or C(R$^U$)$_{nu}$, wherein nu is an integer from 0 to 2 and each R$^U$ is, independently, H, halo, or optionally substituted alkyl (e.g., U is —CH$_2$— or —CH—). In some embodiments, each of R$^1$, R$^2$, and R$^3$ is, independently, H, halo, hydroxy, thiol, optionally substituted alkyl, optionally substituted alkoxy, optionally substituted alkenyloxy, optionally substituted alkynyloxy, optionally substituted aminoalkoxy, optionally substituted alkoxyalkoxy, optionally substituted hydroxyalkoxy, optionally substituted amino, azido, optionally substituted aryl, optionally substituted aminoalkyl, optionally substituted aminoalkenyl, optionally substituted aminoalkynyl, or absent (e.g., each R$^1$ and R$^2$ is, independently, H, halo, hydroxy, optionally substituted alkyl, or optionally substituted alkoxy, e.g., H, halo, hydroxy, alkyl, or alkoxy; and each R$^3$ is, independently, H or optionally substituted alkyl)). In particular embodiments, R$^2$ is optionally substituted alkoxy (e.g., methoxy or ethoxy, or any described herein). In particular embodiments, R$^1$ is optionally substituted alkyl, and R$^2$ is hydroxy. In other embodiments, R$^1$ is hydroxy, and R$^2$ is optionally substituted alkyl. In further embodiments, R$^3$ is optionally substituted alkyl.

In some embodiments, the oncology-related polynucleotide, primary construct, or mmRNA includes an acyclic modified ribose. In some embodiments, the oncology-related polynucleotide, primary construct, or mmRNA (e.g., the first region, the first flanking region, or the second flanking region) includes n number of linked nucleosides having Formula (IId)-(IIf):

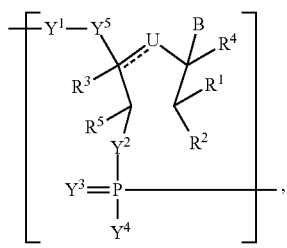

(IId)

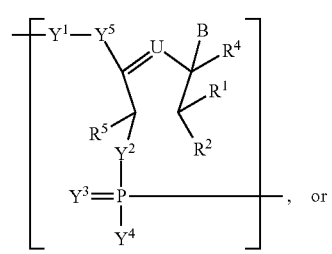

(IIe)

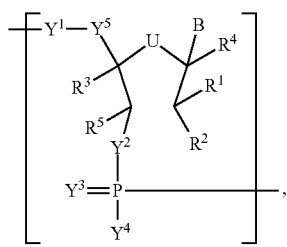

(IIf)

or a pharmaceutically acceptable salt or stereoisomer thereof

In some embodiments, the oncology-related polynucleotide, primary construct, or mmRNA includes an acyclic modified hexitol. In some embodiments, the oncology-related polynucleotide, primary construct, or mmRNA (e.g., the first region, the first flanking region, or the second flanking region) includes n number of linked nucleosides Formula (IIg)-(IIj):

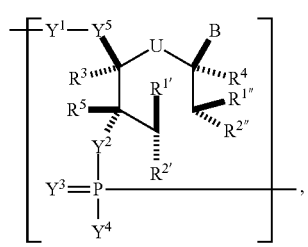

(IIg)

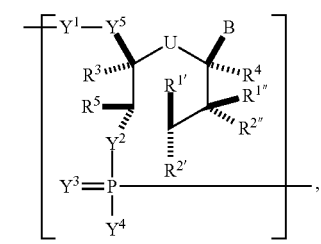

(IIh)

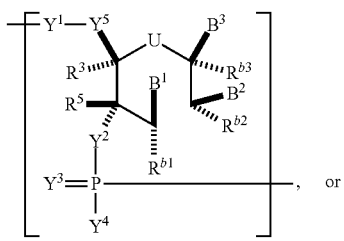

(IIi)

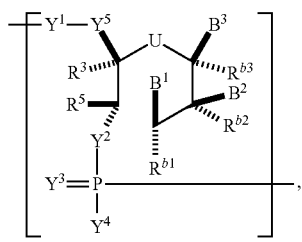

(IIj)

or a pharmaceutically acceptable salt or stereoisomer thereof

In some embodiments, the oncology-related polynucleotide, primary construct, or mmRNA includes a sugar moiety having a contracted or an expanded ribose ring. In some embodiments, the oncology-related polynucleotide, primary construct, or mmRNA (e.g., the first region, the first flanking region, or the second flanking region) includes n number of linked nucleosides having Formula (IIk)-(IIm):

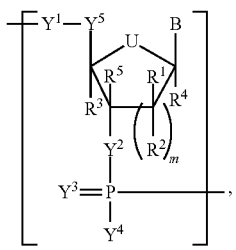

(IIk)

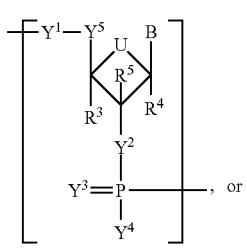

(IIl)

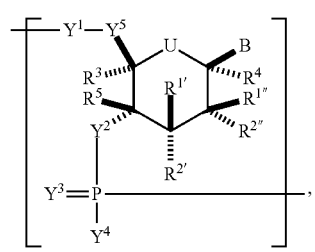

(IIm)

or a pharmaceutically acceptable salt or stereoisomer thereof, wherein each of $R^{1'}$, $R^{1''}$, $R^{2'}$, and $R^{2''}$ is, independently, H, halo, hydroxy, optionally substituted alkyl, optionally substituted alkoxy, optionally substituted alkenyloxy, optionally substituted alkynyloxy, optionally substituted aminoalkoxy, optionally substituted alkoxyalkoxy, or absent; and wherein the combination of $R^{2'}$ and $R^3$ or the combination of $R^{2''}$ and $R^3$ can be taken together to form optionally substituted alkylene or optionally substituted heteroalkylene.

In some embodiments, the oncology-related polynucleotide, primary construct, or mmRNA includes a locked modified ribose. In some embodiments, the oncology-related polynucleotide, primary construct, or mmRNA (e.g., the first region, the first flanking region, or the second flanking region) includes n number of linked nucleosides having Formula (IIn):

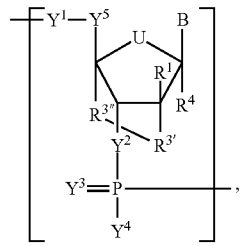

(IIn)

or a pharmaceutically acceptable salt or stereoisomer thereof, wherein $R^{3'}$ is O, S, or —$NR^{N1}$—, wherein $R^{N1}$ is H, optionally substituted alkyl, optionally substituted alkenyl, optionally substituted alkynyl, or optionally substituted aryl and $R^{3''}$ is optionally substituted alkylene (e.g., —$CH_2$—, —$CH_2CH_2$—, or —$CH_2CH_2CH_2$—) or optionally substituted heteroalkylene (e.g., —$CH_2NH$—, —$CH_2CH_2NH$—, —$CH_2OCH_2$—, or —$CH_2CH_2OCH_2$—) (e.g., $R^{3'}$ is O and $R^{3''}$ is optionally substituted alkylene (e.g., —$CH_2$—, —$CH_2CH_2$—, or —$CH_2CH_2CH_2$—)).

In some embodiments, the oncology-related polynucleotide, primary construct, or mmRNA includes n number of linked nucleosides having Formula (IIn-1)-(II-n2):

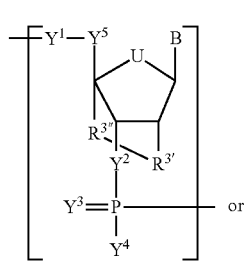

(IIn-1)

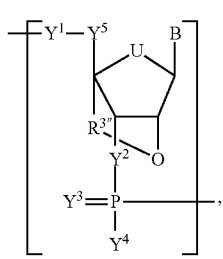

(IIn-2)

or a pharmaceutically acceptable salt or stereoisomer thereof, wherein $R^{3'}$ is O, S, or —$NR^{N1}$—, wherein $R^{N1}$ is H, optionally substituted alkyl, optionally substituted alkenyl, optionally substituted alkynyl, or optionally substituted aryl and $R^{3''}$ is optionally substituted alkylene (e.g., —$CH_2$—, —$CH_2CH_2$—, or —$CH_2CH_2CH_2$—) or optionally substituted heteroalkylene (e.g., —$CH_2NH$—, —$CH_2CH_2NH$—, —$CH_2OCH_2$—, or —$CH_2CH_2OCH_2$—) (e.g., $R^{3'}$ is O and $R^{3''}$ is optionally substituted alkylene (e.g., —$CH_2$—, —$CH_2CH_2$—, or —$CH_2CH_2CH_2$—)).

In some embodiments, the oncology-related polynucleotide, primary construct, or mmRNA includes a locked modified ribose that forms a tetracyclic heterocyclyl. In some embodiments, the oncology-related polynucleotide, primary construct, or mmRNA (e.g., the first region, the first flanking region, or the second flanking region) includes n number of linked nucleosides having Formula (IIo):

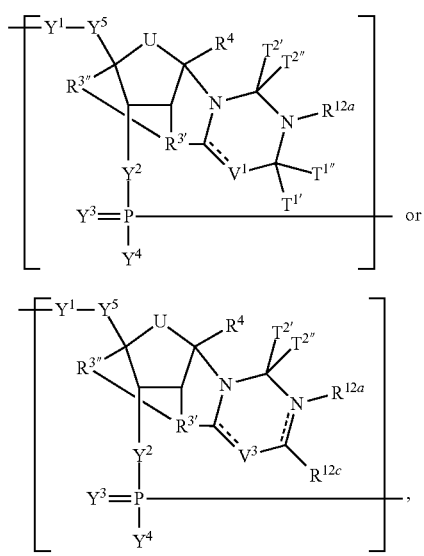

(IIo)

(IIp)

or a pharmaceutically acceptable salt or stereoisomer thereof, wherein $R^{12a}$, $R^{12c}$, $T^{1'}$, $T^{1''}$, $T^{2'}$, $T^{2''}$, $V^1$, and $V^3$ are as described herein.

Any of the formulas for the oncology-related polynucleotides, primary constructs, or mmRNA can include one or more nucleobases described herein (e.g., Formulas (b1)-(b43)).

In one embodiment, the present invention provides methods of preparing a polynucleotide, primary construct, or mmRNA, wherein the polynucleotide comprises n number of nucleosides having Formula (Ia), as defined herein:

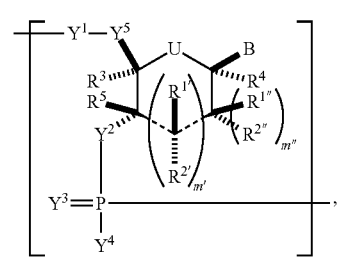

(Ia)

the method comprising reacting a compound of Formula (IIIa), as defined herein:

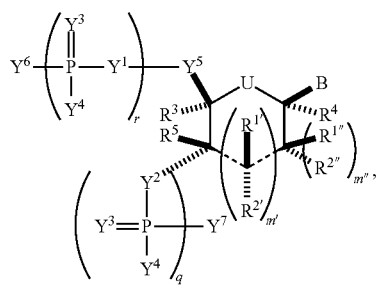

(IIIa)

with an RNA polymerase, and a cDNA template.

In a further embodiment, the present invention provides methods of amplifying a polynucleotide, primary construct, or mmRNA comprising at least one nucleotide (e.g., mmRNA molecule), the method comprising:

reacting a compound of Formula (IIIa), as defined herein, with a primer, a cDNA template, and an RNA polymerase.

In one embodiment, the present invention provides methods of preparing a polynucleotide, primary construct, or mmRNA comprising at least one nucleotide (e.g., mmRNA molecule), wherein the polynucleotide comprises n number of nucleosides having Formula (Ia), as defined herein:

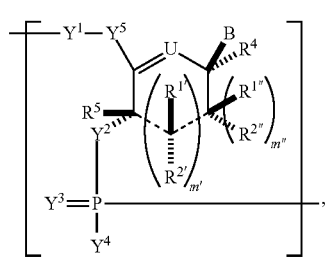

(Ia-1)

the method comprising reacting a compound of Formula (IIIa-1), as defined herein:

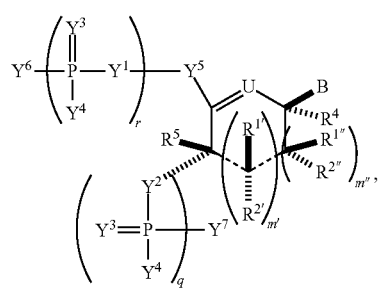

(IIIa-1)

with an RNA polymerase, and a cDNA template.

In a further embodiment, the present invention provides methods of amplifying a polynucleotide, primary construct, or mmRNA comprising at least one nucleotide (e.g., mmRNA molecule), the method comprising:

reacting a compound of Formula (IIIa-1), as defined herein, with a primer, a cDNA template, and an RNA polymerase.

In one embodiment, the present invention provides methods of preparing a modified mRNA comprising at least one nucleotide (e.g., mmRNA molecule), wherein the polynucleotide comprises n number of nucleosides having Formula (Ia-2), as defined herein:

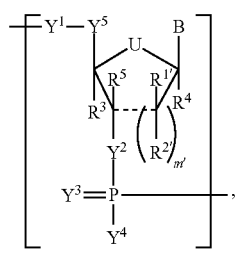
(Ia-2)

the method comprising reacting a compound of Formula (IIIa-2), as defined herein:

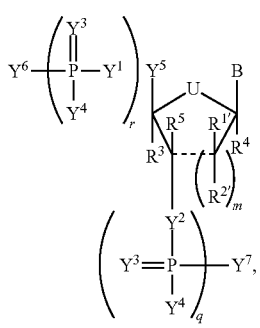
(IIIa-2)

with an RNA polymerase, and a cDNA template.

In a further embodiment, the present invention provides methods of amplifying a modified mRNA comprising at least one nucleotide (e.g., mmRNA molecule), the method comprising:

reacting a compound of Formula (IIIa-2), as defined herein, with a primer, a cDNA template, and an RNA polymerase.

In some embodiments, the reaction may be repeated from 1 to about 7,000 times. In any of the embodiments herein, B may be a nucleobase of Formula (b1)-(b43).

The oncology-related polynucleotides, primary constructs, and mmRNA can optionally include 5' and/or 3' flanking regions, which are described herein.

Modified RNA (mmRNA) Molecules

The present invention also includes building blocks, e.g., modified ribonucleosides, modified ribonucleotides, of modified RNA (mmRNA) molecules. For example, these building blocks can be useful for preparing the oncology-related polynucleotides, primary constructs, or mmRNA of the invention.

In some embodiments, the building block molecule has Formula (IIIa) or (IIIa-1):

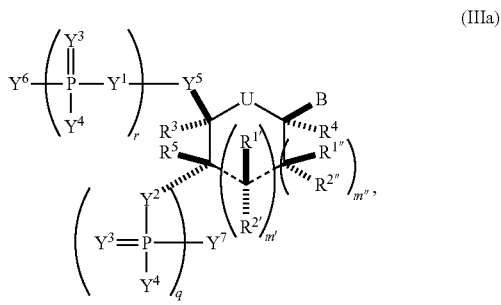
(IIIa)

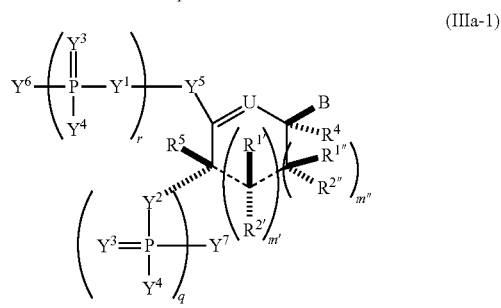
(IIIa-1)

or a pharmaceutically acceptable salt or stereoisomer thereof, wherein the substituents are as described herein (e.g., for Formula (Ia) and (Ia-1)), and wherein when B is an unmodified nucleobase selected from cytosine, guanine, uracil and adenine, then at least one of $Y^1$, $Y^2$, or $Y^3$ is not O.

In some embodiments, the building block molecule, which may be incorporated into a polynucleotide, primary construct, or mmRNA, has Formula (IVa)-(IVb):

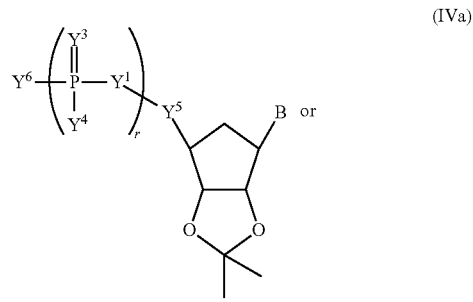
(IVa)

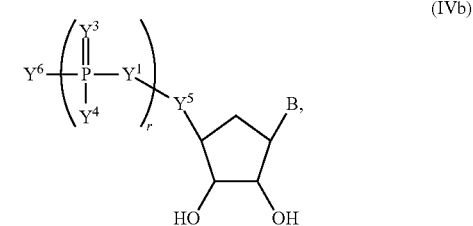
(IVb)

or a pharmaceutically acceptable salt or stereoisomer thereof, wherein B is as described herein (e.g., any one of (b1)-(b43)). In particular embodiments, Formula (IVa) or (IVb) is combined with a modified uracil (e.g., any one of formulas (b1)-(b9), (b21)-(b23), and (b28)-(b31), such as formula (b1), (b8), (b28), (b29), or (b30)). In particular embodiments, Formula (IVa) or (IVb) is combined with a modified cytosine (e.g., any one of formulas (b10)-(b14), (b24), (b25), and (b32)-(b36), such as formula (b10) or (b32)). In particular embodiments, Formula (IVa) or (IVb) is combined with a modified guanine (e.g., any one of formulas (b15)-(b17) and (b37)-(b40)). In particular embodiments, Formula (IVa) or (IVb) is combined with a modified adenine (e.g., any one of formulas (b18)-(b20) and (b41)-(b43)).

In some embodiments, the building block molecule, which may be incorporated into a polynucleotide, primary construct, or mmRNA, has Formula (IVc)-(IVk):

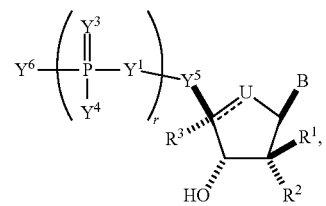
(IVc)

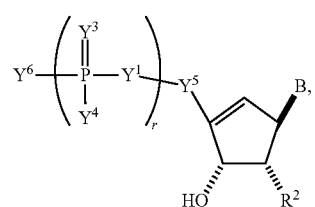
(IVd)

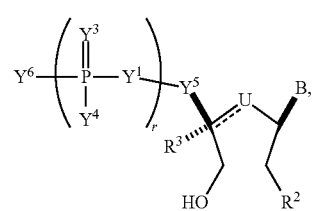
(IVe)

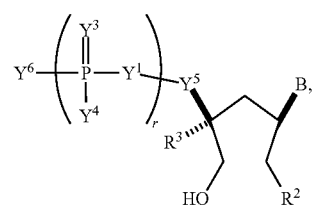
(IVf)

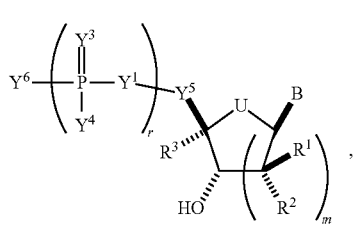
(IVg)

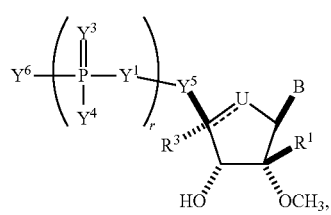
(IVh)

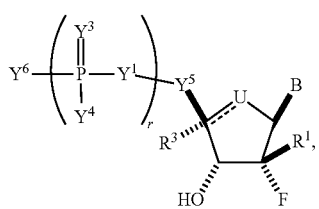
(IVi)

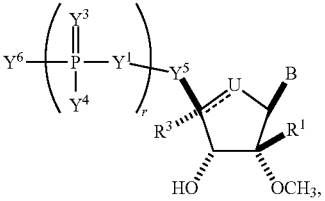
(IVj)

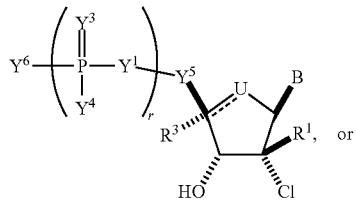
(IVk)

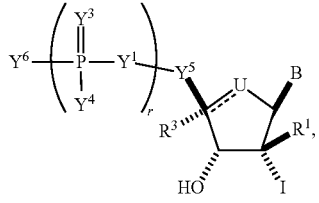
(IVl)

or a pharmaceutically acceptable salt or stereoisomer thereof, wherein B is as described herein (e.g., any one of (b1)-(b43)). In particular embodiments, one of Formulas (IVc)-(IVk) is combined with a modified uracil (e.g., any one of formulas (b1)-(b9), (b21)-(b23), and (b28)-(b31), such as formula (b1), (b8), (b28), (b29), or (b30)). In particular embodiments, one of Formulas (IVc)-(IVk) is combined with a modified cytosine (e.g., any one of formulas (b10)-(b14), (b24), (b25), and (b32)-(b36), such as formula (b10) or (b32)). In particular embodiments, one of Formulas (IVc)-(IVk) is combined with a modified guanine (e.g., any one of formulas (b15)-(b17) and (b37)-(b40)). In particular embodiments, one of Formulas (IVc)-(IVk) is combined with a modified adenine (e.g., any one of formulas (b18)-(b20) and (b41)-(b43)).

In other embodiments, the building block molecule, which may be incorporated into a polynucleotide, primary construct, or mmRNA, has Formula (Va) or (Vb):

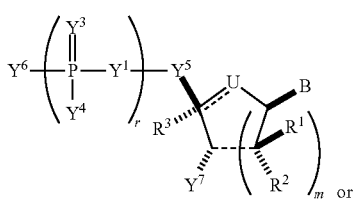
(Va)

-continued

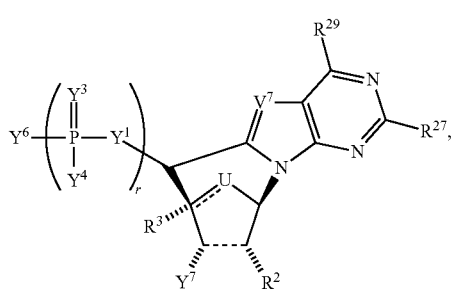
(Vb)

or a pharmaceutically acceptable salt or stereoisomer thereof, wherein B is as described herein (e.g., any one of (b1)-(b43)).

In other embodiments, the building block molecule, which may be incorporated into a polynucleotide, primary construct, or mmRNA, has Formula (IXa)-(IXd):

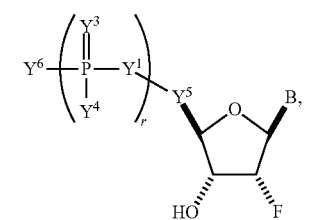
(IXa)

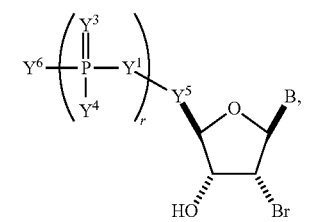
(IXb)

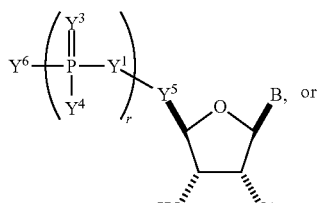
(IXc)

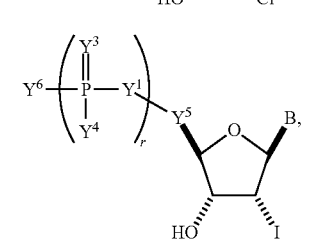
(IXd)

or a pharmaceutically acceptable salt or stereoisomer thereof, wherein B is as described herein (e.g., any one of (b1)-(b43)). In particular embodiments, one of Formulas (IXa)-(IXd) is combined with a modified uracil (e.g., any one of formulas (b1)-(b9), (b21)-(b23), and (b28)-(b31), such as formula (b1), (b8), (b28), (b29), or (b30)). In particular embodiments, one of Formulas (IXa)-(IXd) is combined with a modified cytosine (e.g., any one of formulas (b10)-(b14), (b24), (b25), and (b32)-(b36), such as formula (b10) or (b32)). In particular embodiments, one of Formulas (IXa)-(IXd) is combined with a modified guanine (e.g., any one of formulas (b15)-(b17) and (b37)-(b40)). In particular embodiments, one of Formulas (IXa)-(IXd) is combined with a modified adenine (e.g., any one of formulas (b18)-(b20) and (b41)-(b43)).

In other embodiments, the building block molecule, which may be incorporated into a polynucleotide, primary construct, or mmRNA, has Formula (IXe)-(IXg):

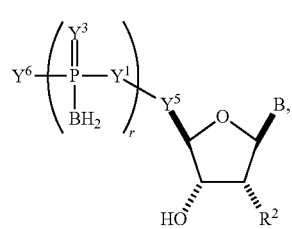
(IXe)

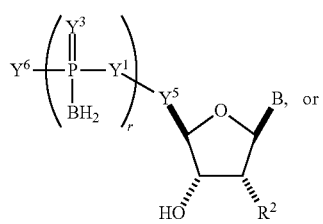
(IXf)

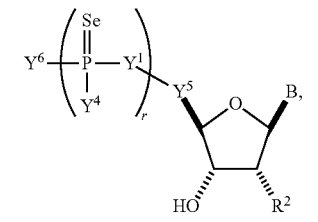
(IXg)

or a pharmaceutically acceptable salt or stereoisomer thereof, wherein B is as described herein (e.g., any one of (b1)-(b43)). In particular embodiments, one of Formulas (IXe)-(IXg) is combined with a modified uracil (e.g., any one of formulas (b1)-(b9), (b21)-(b23), and (b28)-(b31), such as formula (b1), (b8), (b28), (b29), or (b30)). In particular embodiments, one of Formulas (IXe)-(IXg) is combined with a modified cytosine (e.g., any one of formulas (b10)-(b14), (b24), (b25), and (b32)-(b36), such as formula (b10) or (b32)). In particular embodiments, one of Formulas (IXe)-(IXg) is combined with a modified guanine (e.g., any one of formulas (b15)-(b17) and (b37)-(b40)). In particular embodiments, one of Formulas (IXe)-(IXg) is combined with a modified adenine (e.g., any one of formulas (b18)-(b20) and (b41)-(b43)).

In other embodiments, the building block molecule, which may be incorporated into a polynucleotide, primary construct, or mmRNA, has Formula (IXh)-(IXk):

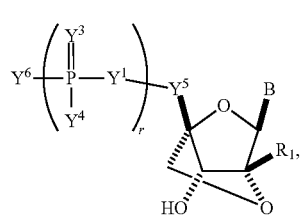
(IXh)

-continued

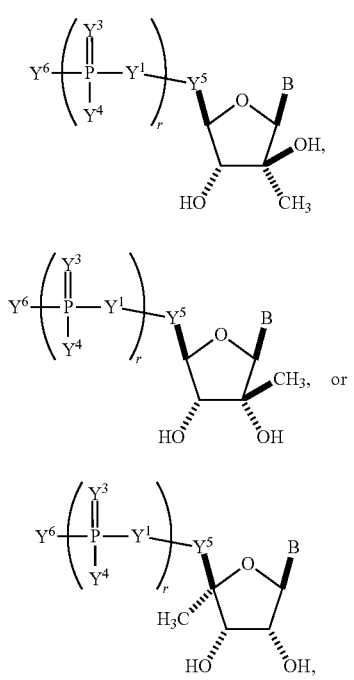

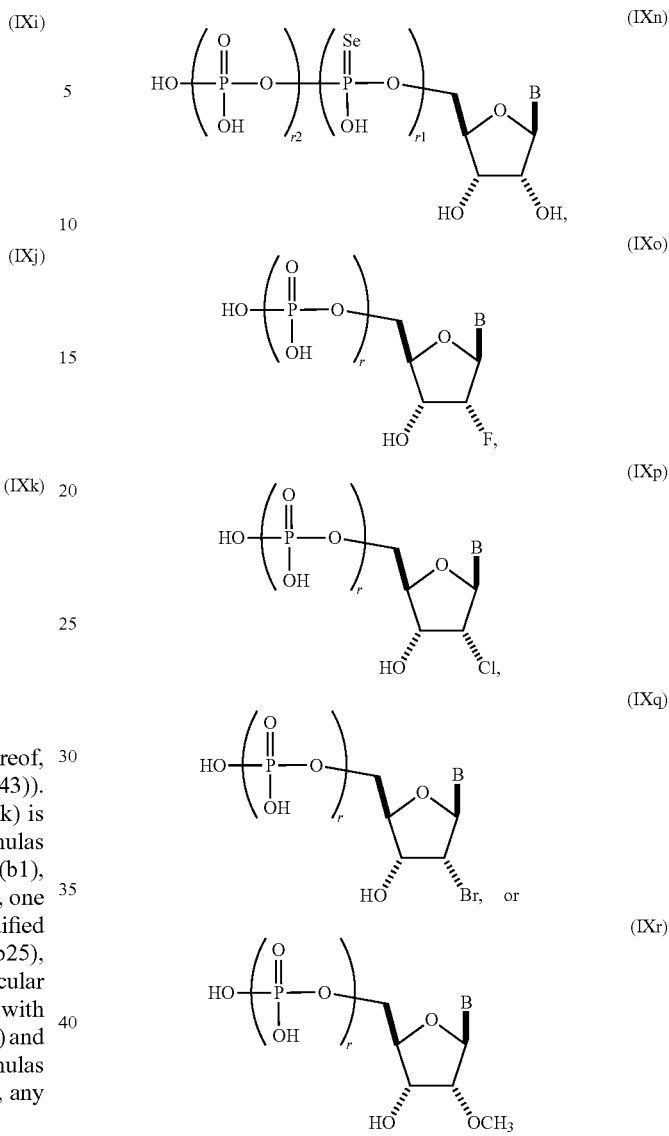

or a pharmaceutically acceptable salt or stereoisomer thereof, wherein B is as described herein (e.g., any one of (b1)-(b43)). In particular embodiments, one of Formulas (IXh)-(IXk) is combined with a modified uracil (e.g., any one of formulas (b1)-(b9), (b21)-(b23), and (b28)-(b31), such as formula (b1), (b8), (b28), (b29), or (b30)). In particular embodiments, one of Formulas (IXh)-(IXk) is combined with a modified cytosine (e.g., any one of formulas (b10)-(b14), (b24), (b25), and (b32)-(b36), such as formula (b10) or (b32)). In particular embodiments, one of Formulas (IXh)-(IXk) is combined with a modified guanine (e.g., any one of formulas (b15)-(b17) and (b37)-(b40)). In particular embodiments, one of Formulas (IXh)-(IXk) is combined with a modified adenine (e.g., any one of formulas (b18)-(b20) and (b41)-(b43)).

In other embodiments, the building block molecule, which may be incorporated into a polynucleotide, primary construct, or mmRNA, has Formula (IXl)-(IXr):

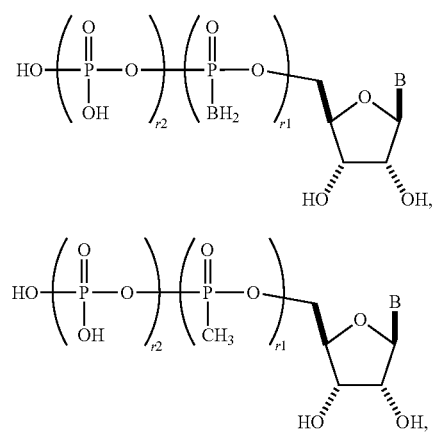

or a pharmaceutically acceptable salt or stereoisomer thereof, wherein each r1 and r2 is, independently, an integer from 0 to 5 (e.g., from 0 to 3, from 1 to 3, or from 1 to 5) and B is as described herein (e.g., any one of (b1)-(b43)). In particular embodiments, one of Formulas (IXl)-(IXr) is combined with a modified uracil (e.g., any one of formulas (b1)-(b9), (b21)-(b23), and (b28)-(b31), such as formula (b1), (b8), (b28), (b29), or (b30)). In particular embodiments, one of Formulas (IXl)-(IXr) is combined with a modified cytosine (e.g., any one of formulas (b10)-(b14), (b24), (b25), and (b32)-(b36), such as formula (b10) or (b32)). In particular embodiments, one of Formulas (IXl)-(IXr) is combined with a modified guanine (e.g., any one of formulas (b15)-(b17) and (b37)-(b40)). In particular embodiments, one of Formulas (IXl)-(IXr) is combined with a modified adenine (e.g., any one of formulas (b18)-(b20) and (b41)-(b43)).

In some embodiments, the building block molecule, which may be incorporated into a polynucleotide, primary construct, or mmRNA, can be selected from the group consisting of:

(BB-1)
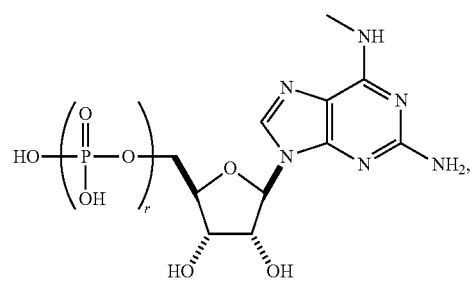
(BB-2)
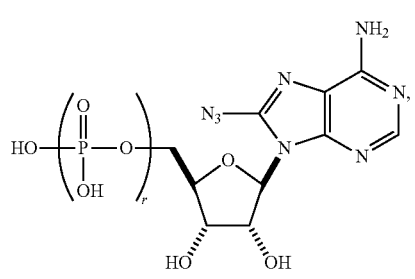
(BB-3)
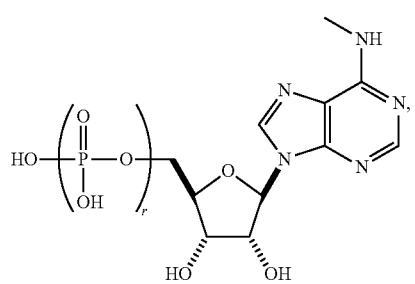
(BB-4)
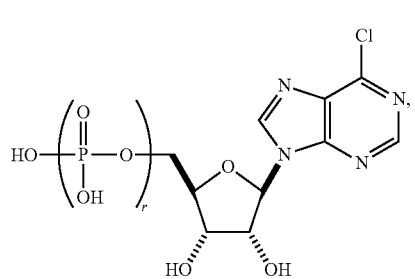
(BB-5)
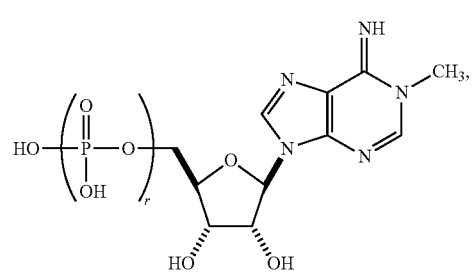
(BB-6)
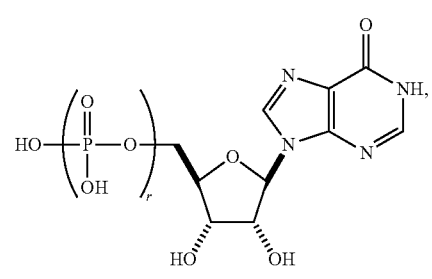
(BB-7)
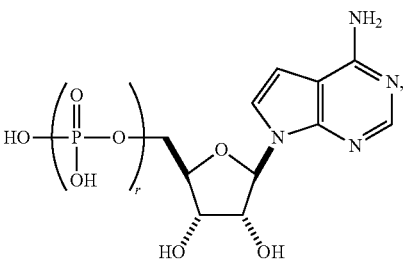
(BB-8)
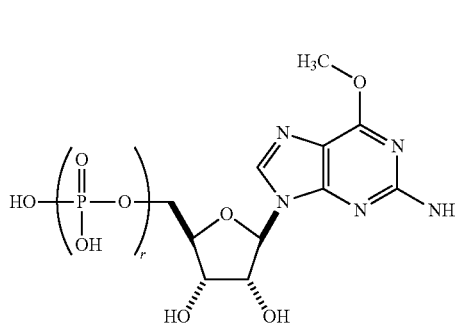
(BB-9)
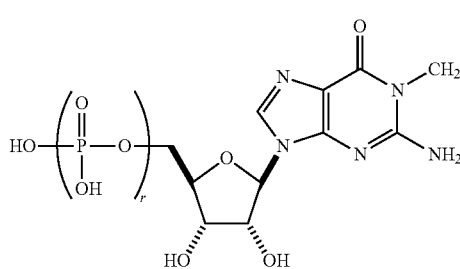
(BB-10)
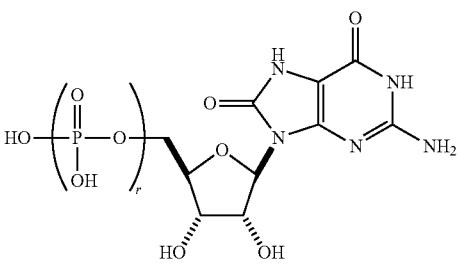
(BB-11)
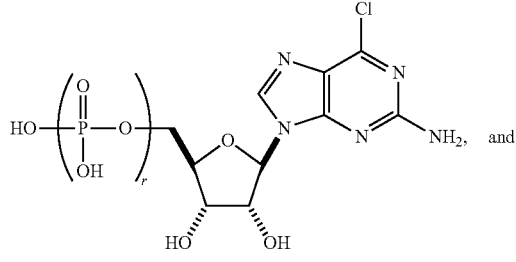

(BB-12)

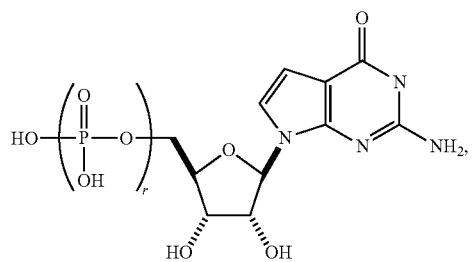

or a pharmaceutically acceptable salt or stereoisomer thereof, wherein each r is, independently, an integer from 0 to 5 (e.g., from 0 to 3, from 1 to 3, or from 1 to 5).

In some embodiments, the building block molecule, which may be incorporated into a polynucleotide, primary construct, or mmRNA, can be selected from the group consisting of:

(BB-13)

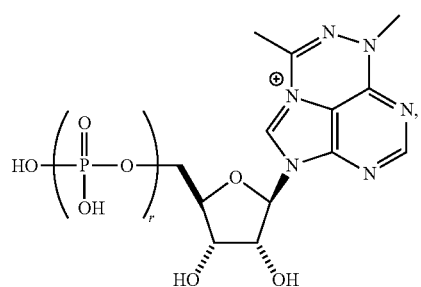

(BB-14)

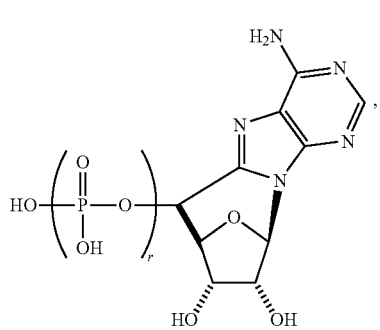

(BB-15)

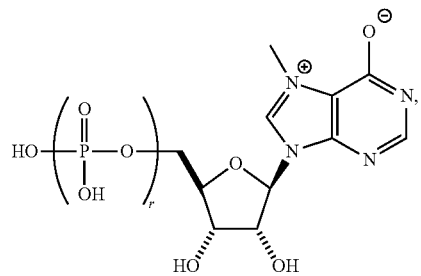

(BB-16)

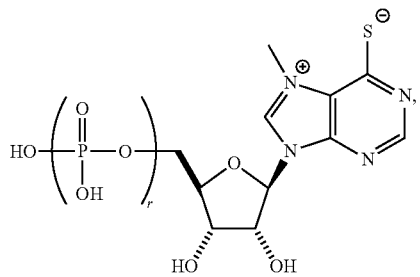

(BB-17)

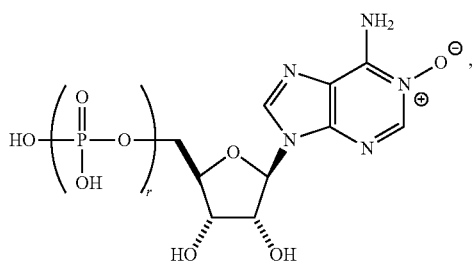

(BB-18)

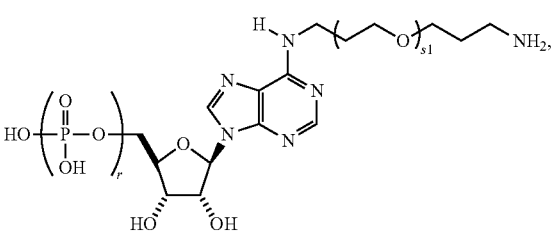

(BB-19)

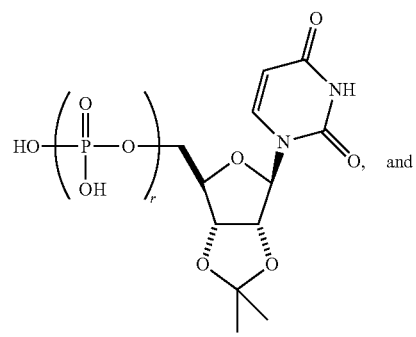

(BB-20)

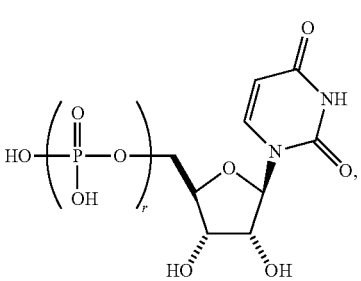

or a pharmaceutically acceptable salt or stereoisomer thereof, wherein each r is, independently, an integer from 0 to 5 (e.g., from 0 to 3, from 1 to 3, or from 1 to 5) and s1 is as described herein.

In some embodiments, the building block molecule, which may be incorporated into a nucleic acid (e.g., RNA, mRNA, polynucleotide, primary construct, or mmRNA), is a modified uridine (e.g., selected from the group consisting of:

(BB-21) 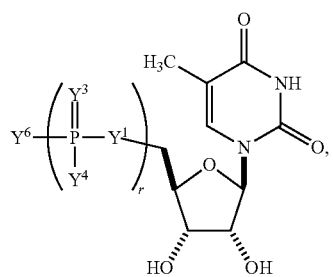
(BB-22) 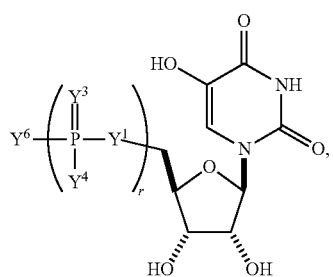
(BB-23) 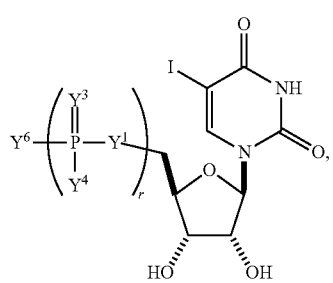
(BB-24) 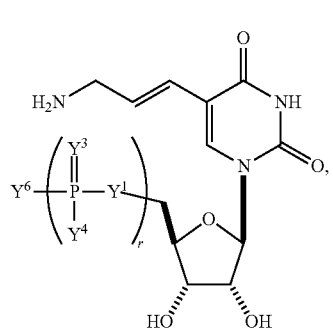
(BB-25) 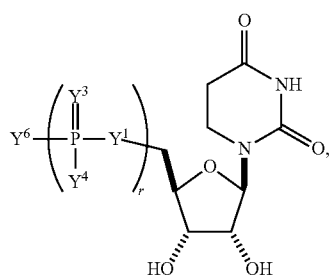
-continued
(BB-26) 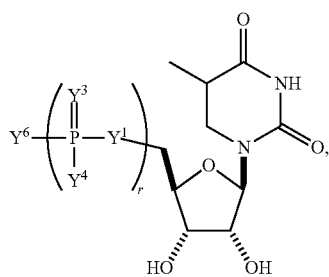
(BB-27) 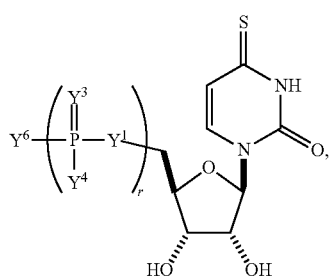
(BB-28) 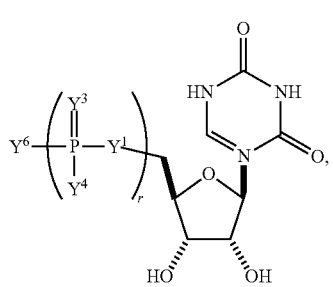
(BB-29) 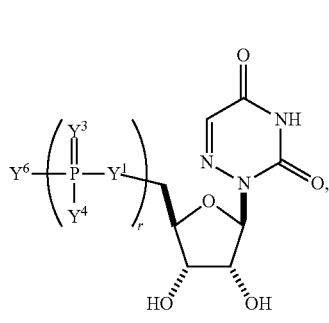
(BB-30)

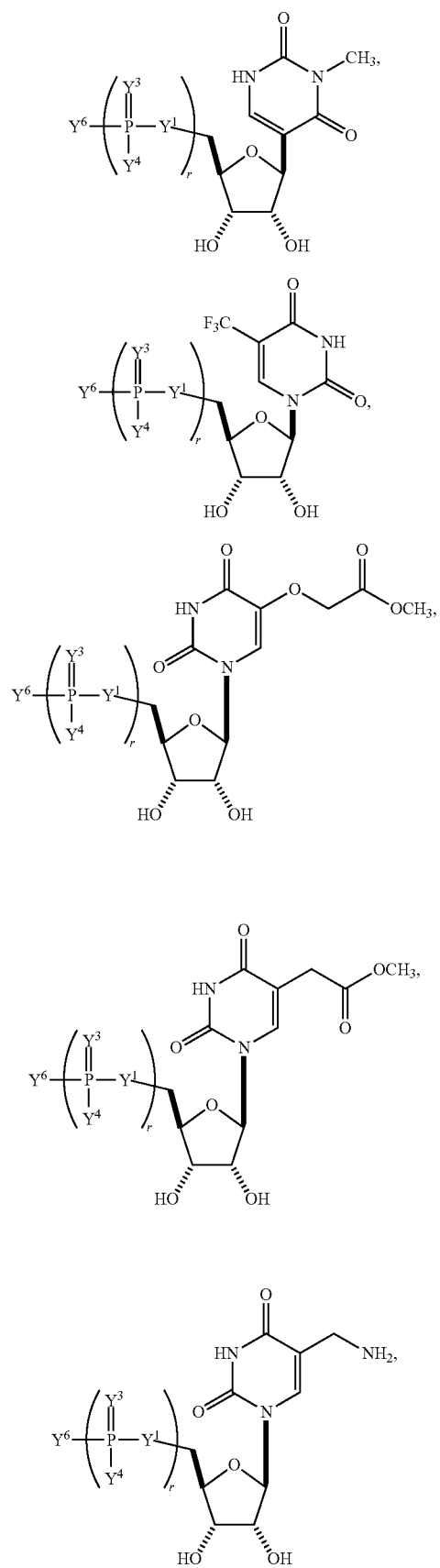

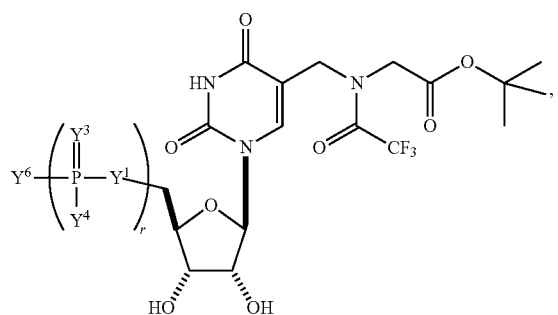
(BB-41)
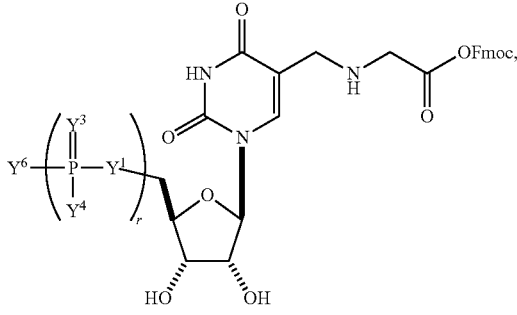
(BB-45)
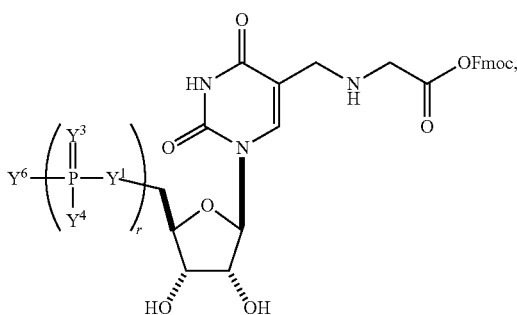
(BB-46)
(BB-42)
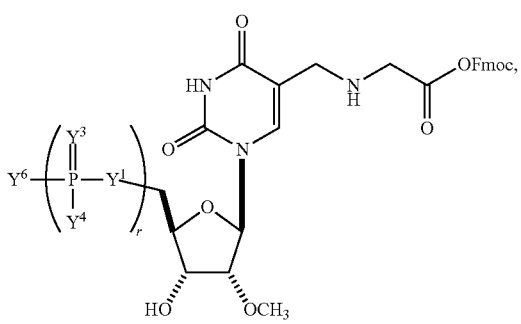
(BB-47)
(BB-43)
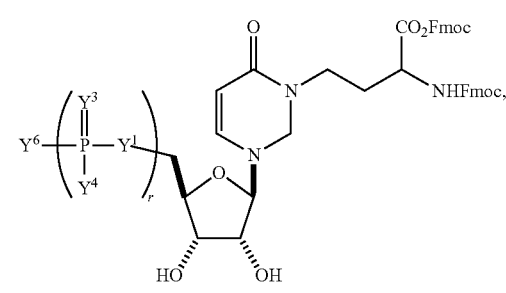
(BB-48)
(BB-44)
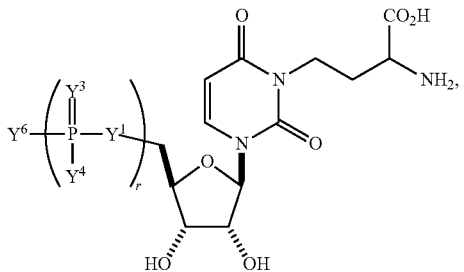
(BB-49)

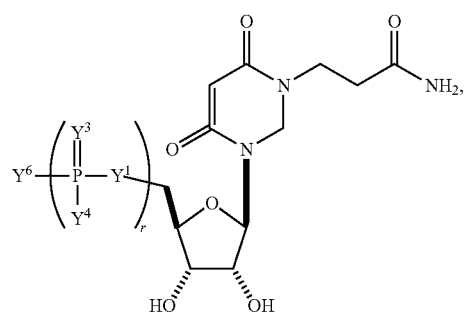 (BB-50)
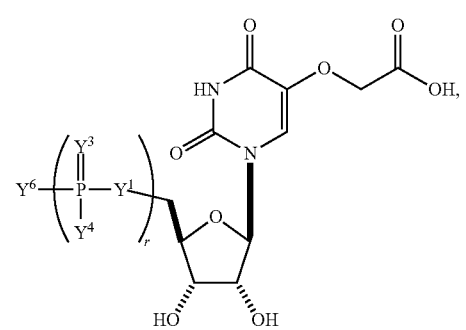 (BB-51)
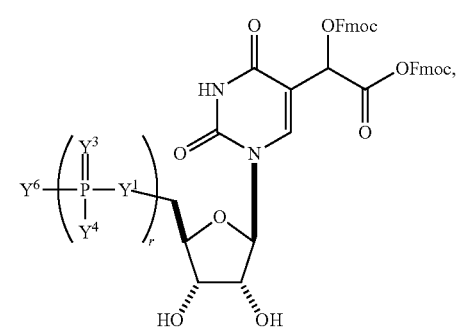 (BB-52)
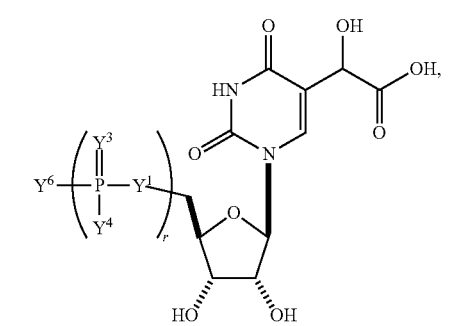 (BB-53)
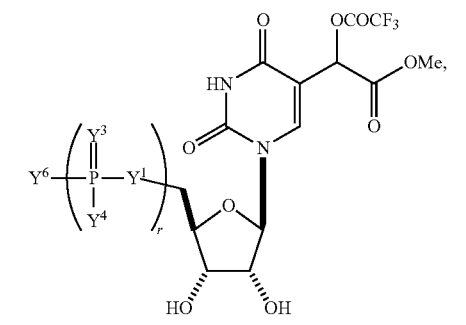 (BB-54)
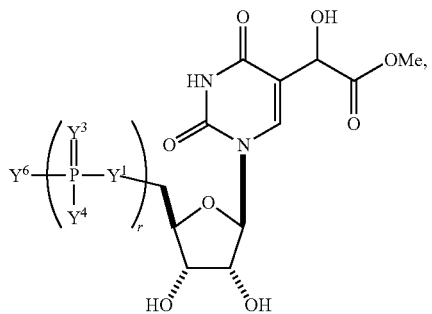 (BB-55)
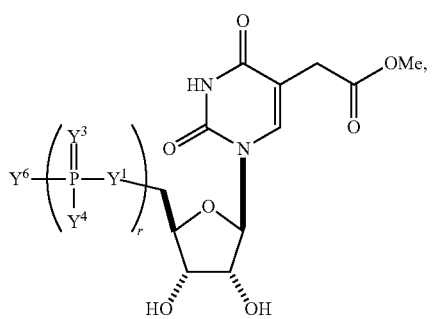 (BB-56)
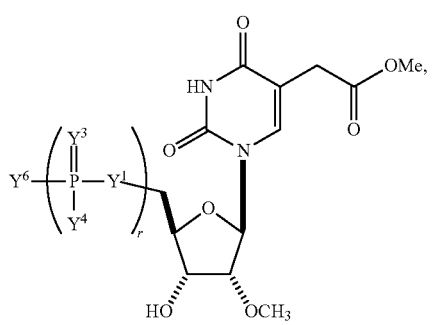 (BB-57)
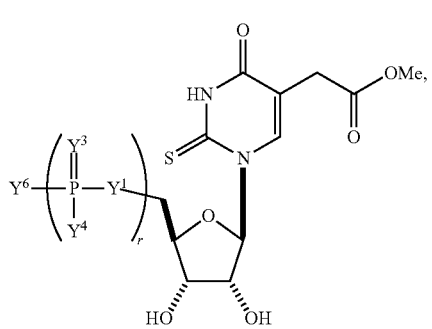 (BB-58)
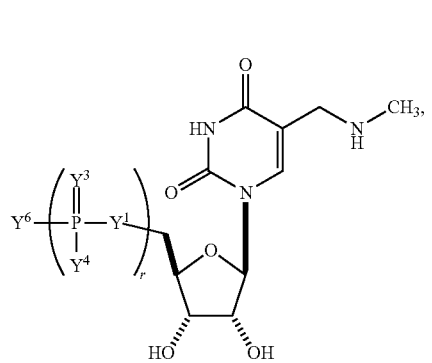 (BB-59)

(BB-60)
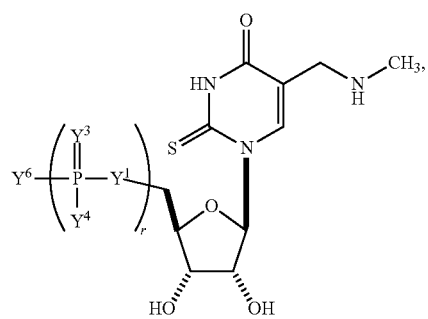
(BB-61)
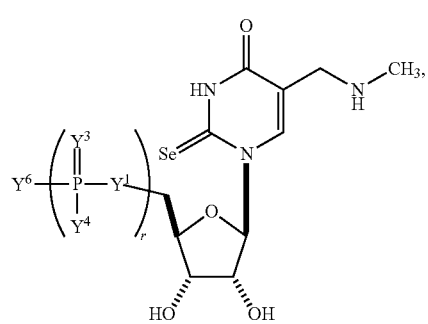
(BB-62)
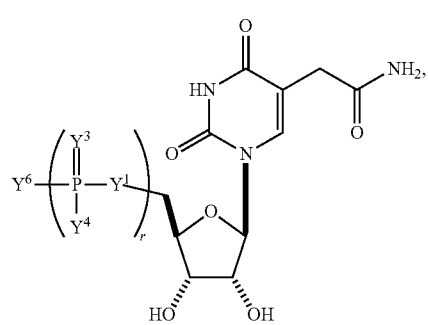
(BB-63)
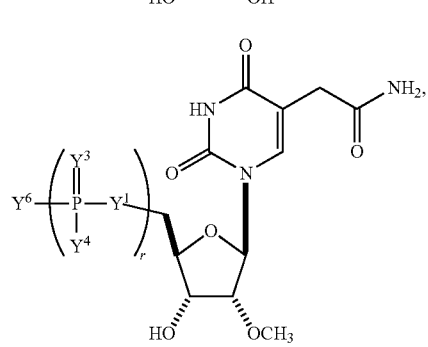
(BB-64)
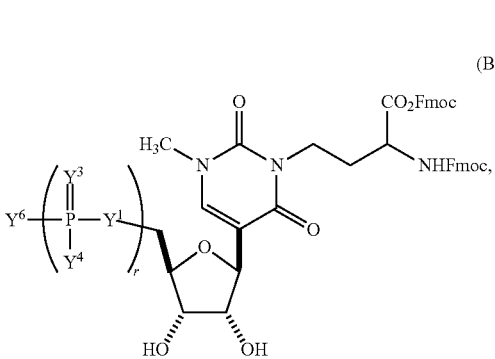
(BB-65)
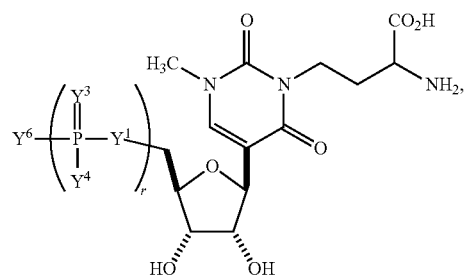
(BB-66)
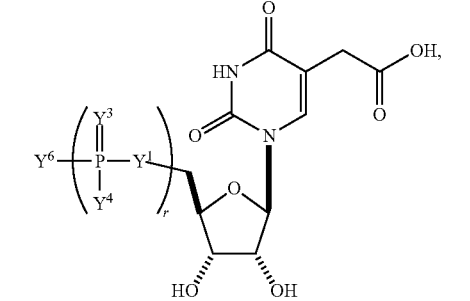
(BB-67)
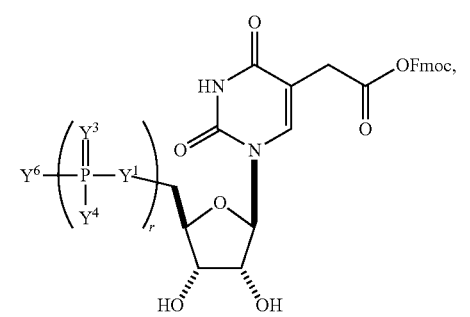
(BB-68)
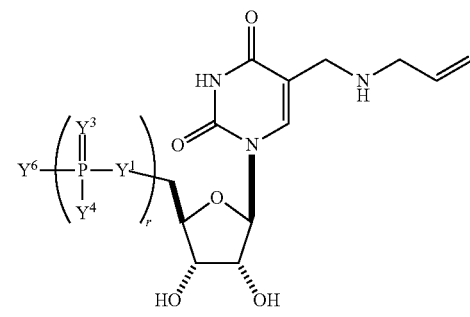
(BB-69)
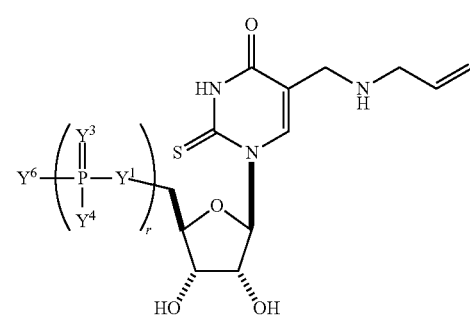

(BB-70)
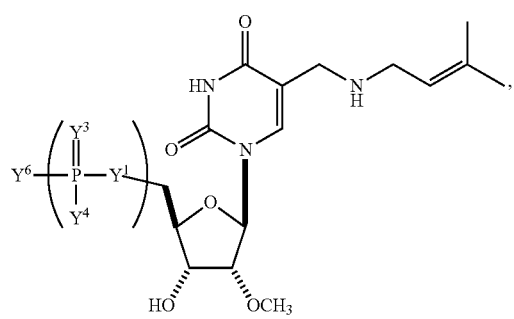
(BB-71)
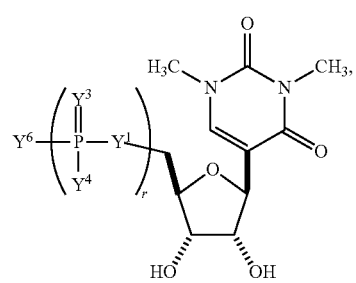
(BB-72)
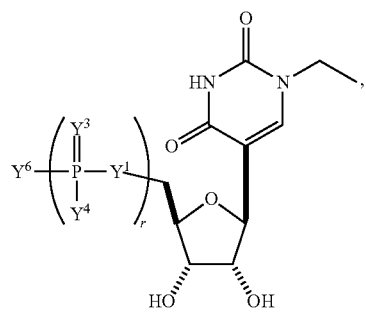
(BB-73)
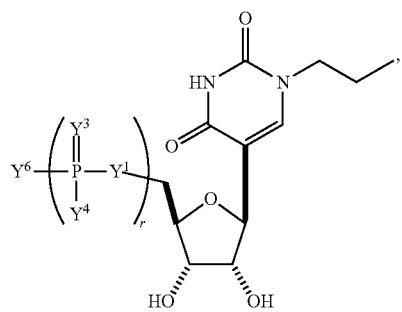
(BB-74)
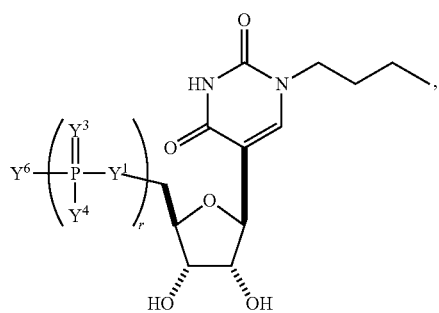
(BB-75)
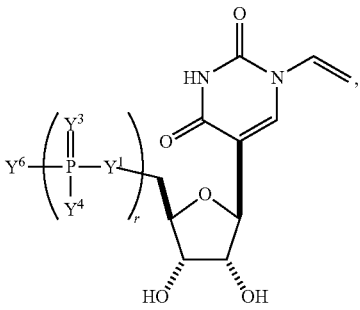
(BB-76)
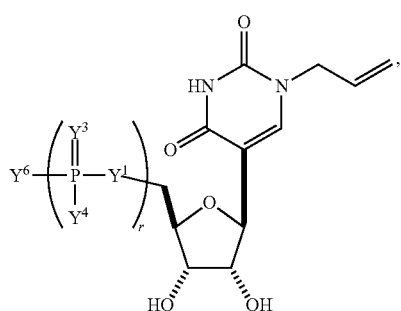
(BB-77)
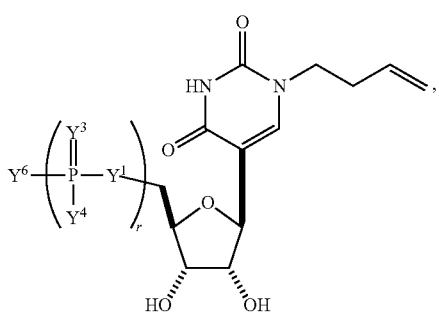
(BB-78)
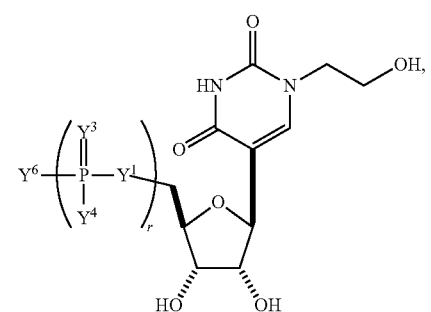
(BB-79)
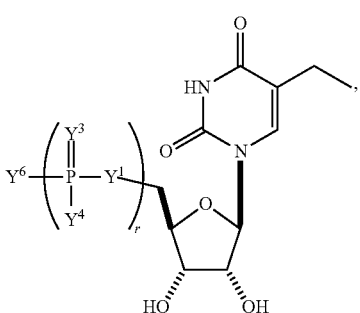

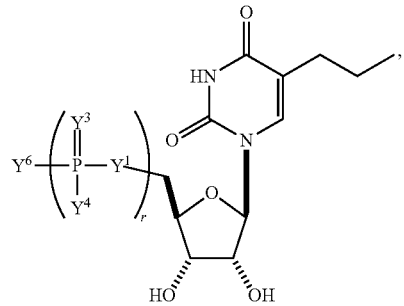
(BB-80)
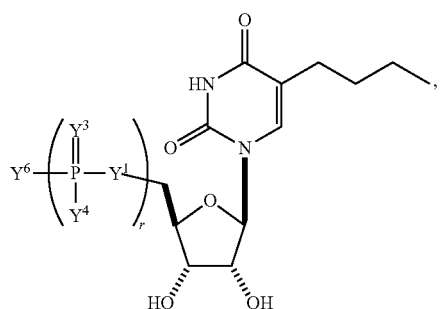
(BB-81)
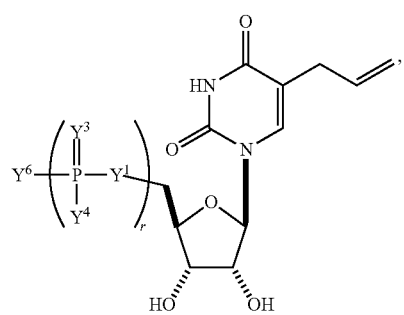
(BB-82)
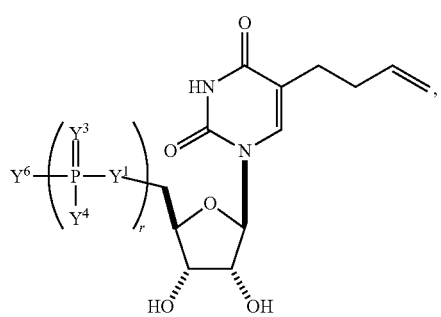
(BB-83)
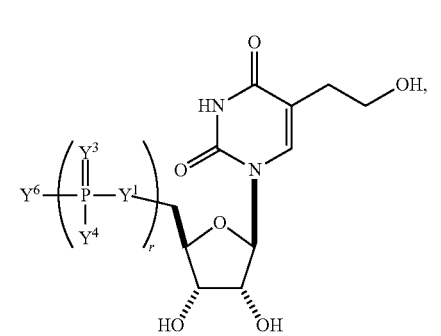
(BB-84)
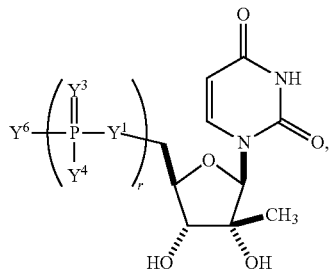
(BB-85)
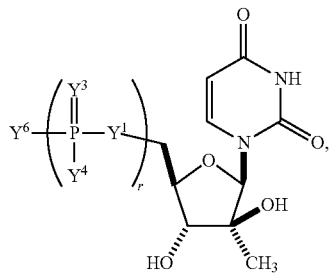
(BB-86)
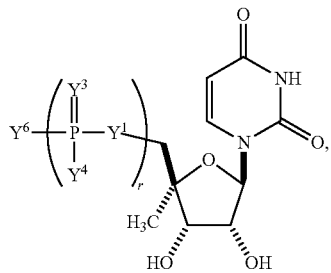
(BB-87)
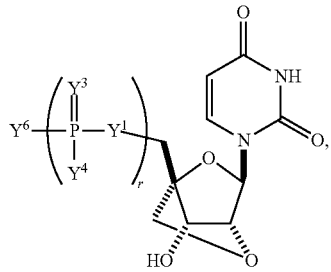
(BB-88)
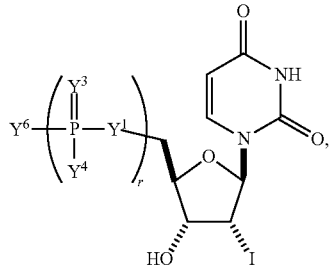
(BB-89)

(BB-90) 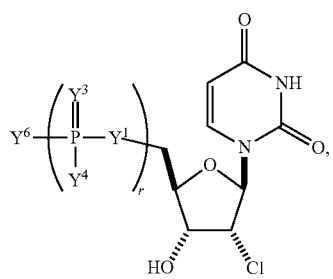
(BB-91) 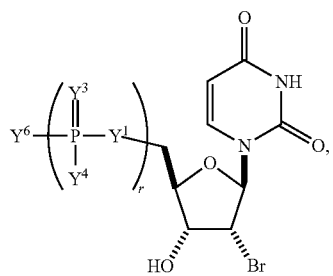
(BB-92) 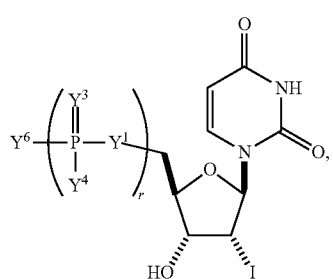
(BB-93) 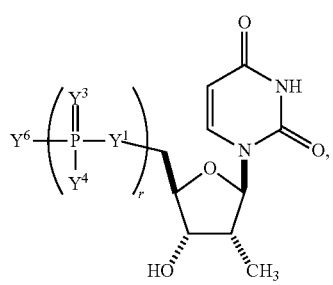
(BB-94) 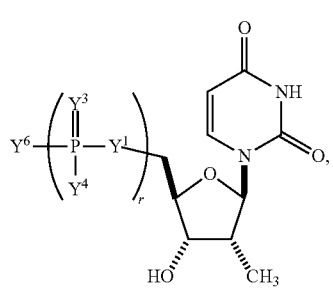
(BB-95) 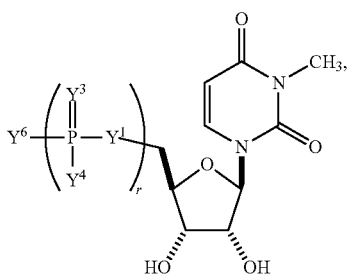
(BB-96) 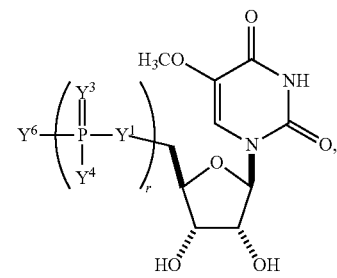
(BB-97) 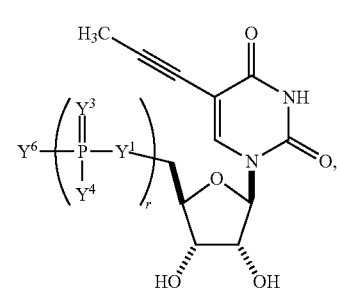
(BB-98) 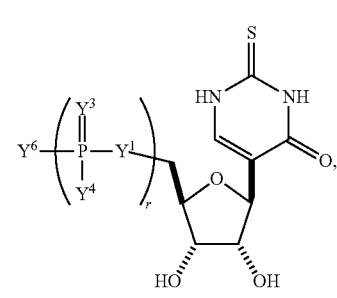
(BB-99) 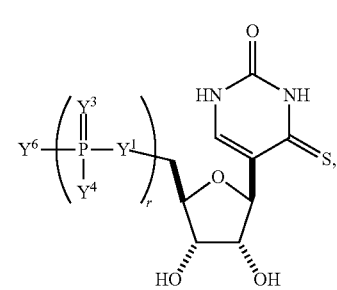

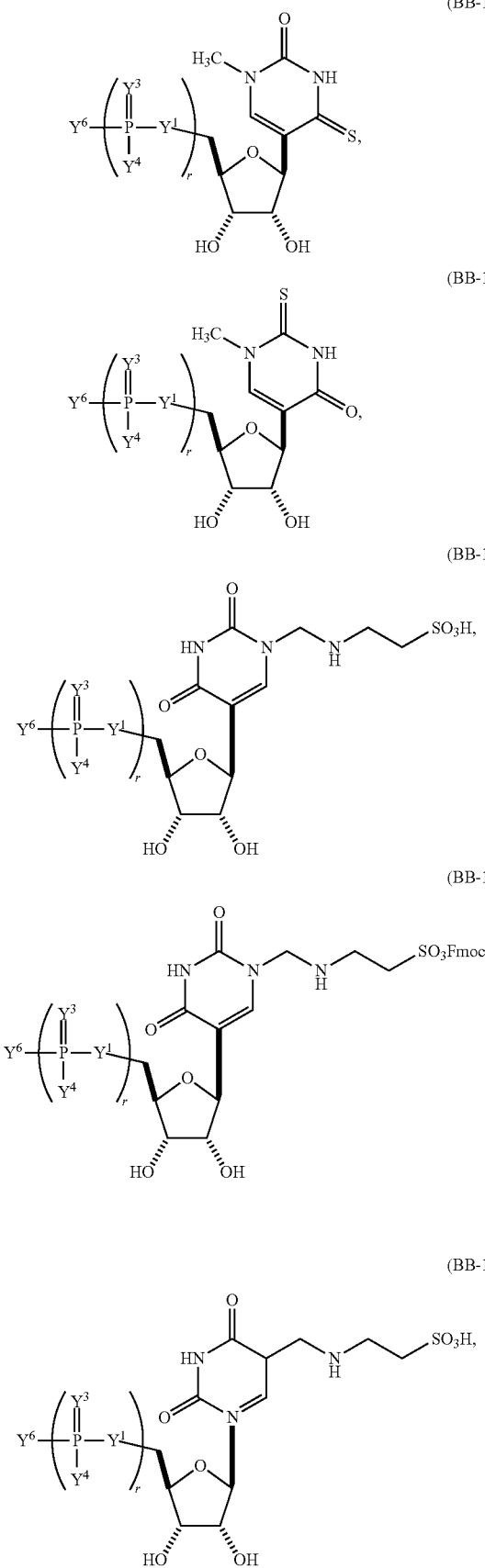
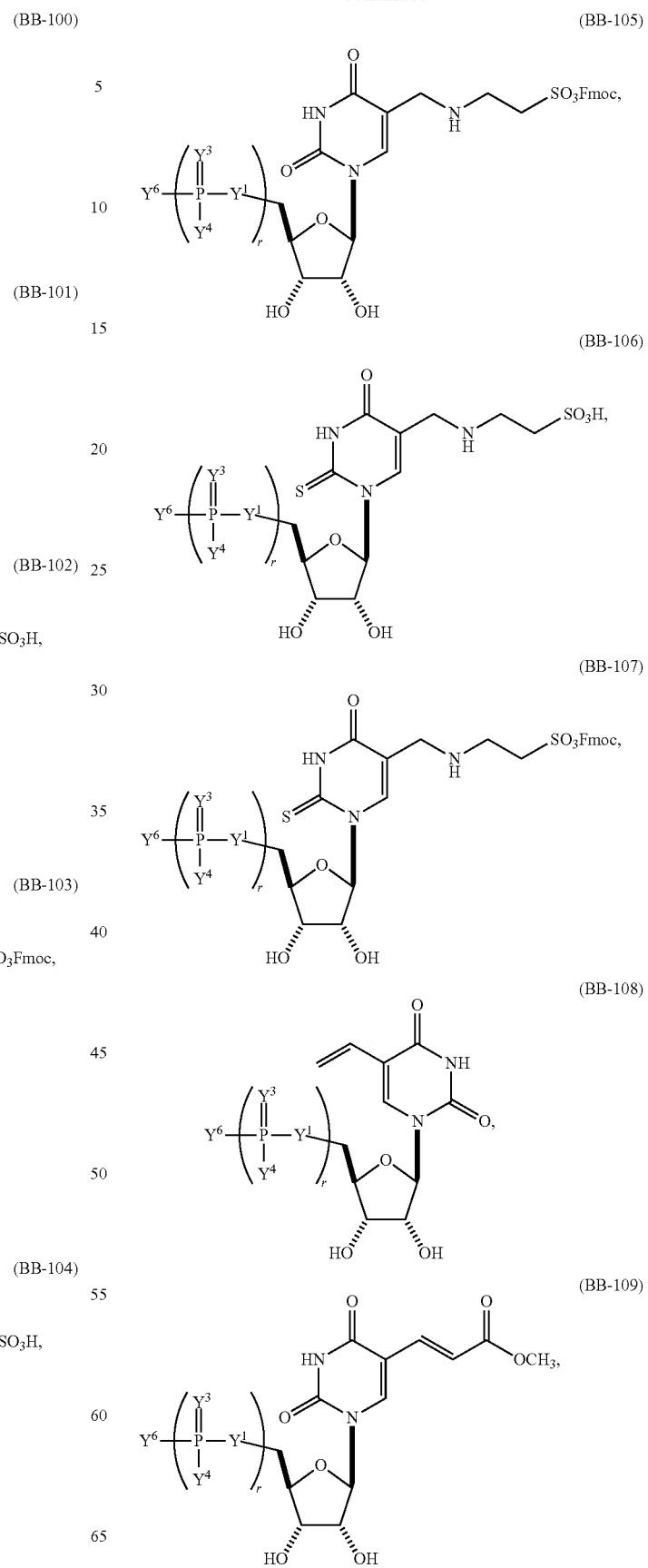

(BB-110)
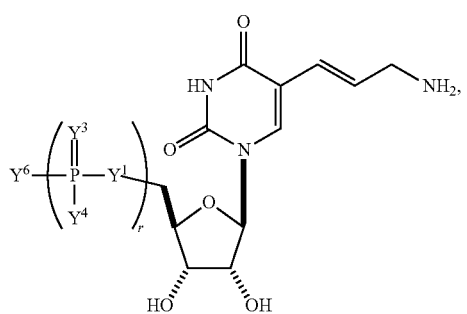
(BB-111)
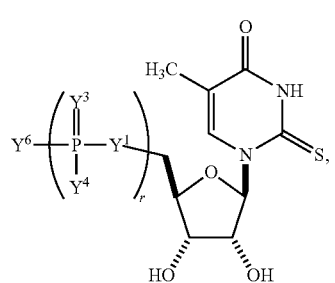
(BB-112)
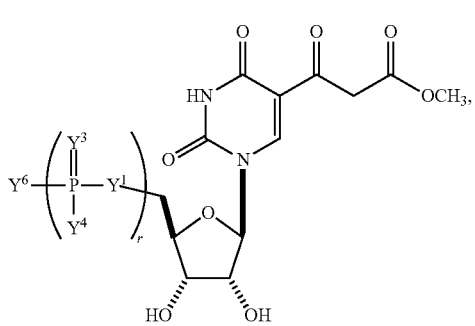
(BB-113)
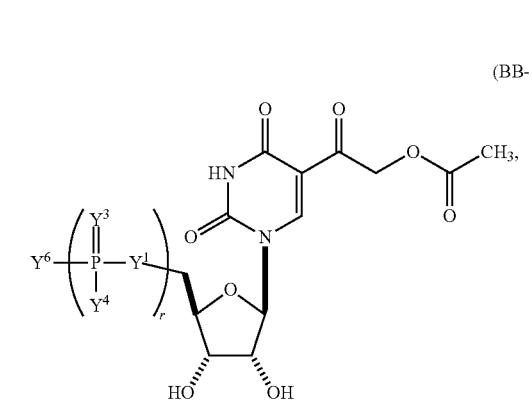
(BB-114)
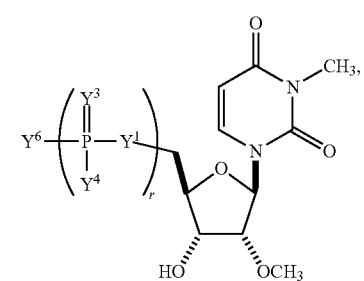
(BB-115)
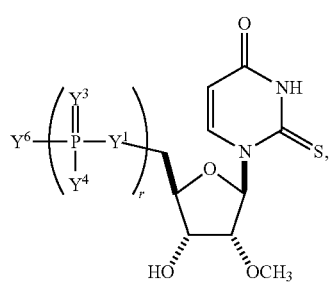
(BB-116)
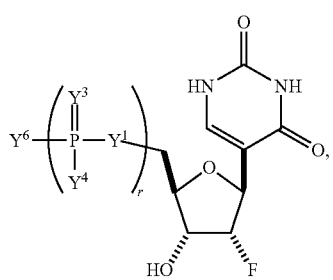
(BB-117)
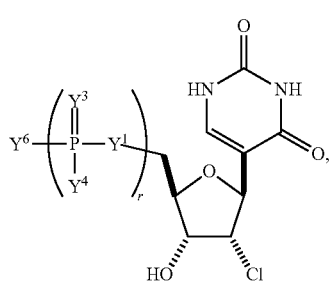
(BB-118)
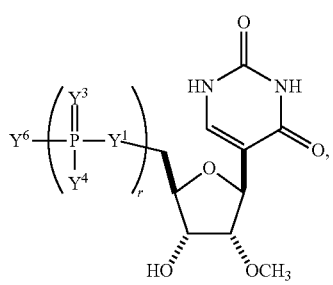
(BB-119)
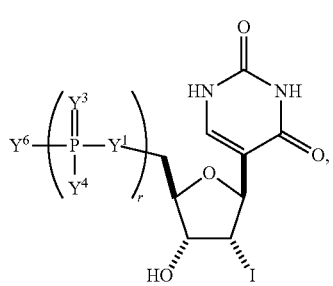

-continued (BB-120)
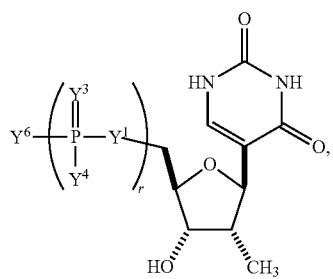

(BB-121)
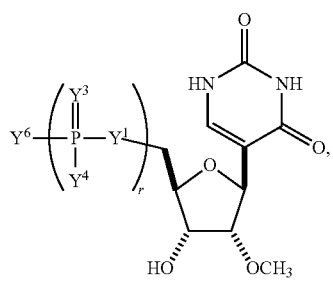

(BB-122)
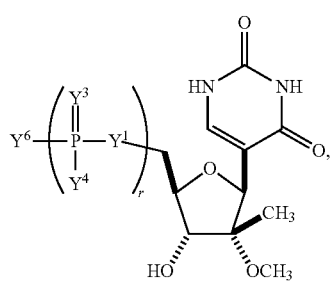

(BB-123)
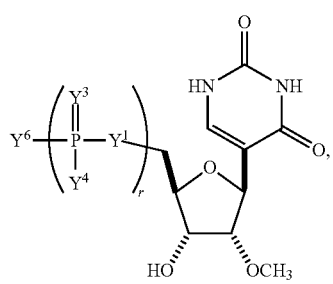

(BB-124)
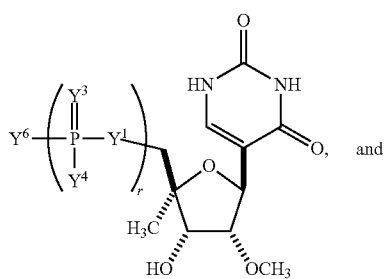
and

-continued (BB-125)
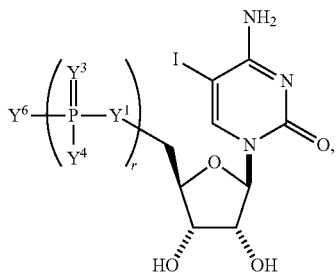

or a pharmaceutically acceptable salt or stereoisomer thereof, wherein $Y^1$, $Y^3$, $Y^4$, $Y^6$, and r are as described herein (e.g., each r is, independently, an integer from 0 to 5, such as from 0 to 3, from 1 to 3, or from 1 to 5)).

In some embodiments, the building block molecule, which may be incorporated into a polynucleotide, primary construct, or mmRNA, is a modified cytidine (e.g., selected from the group consisting of:

(BB-126)
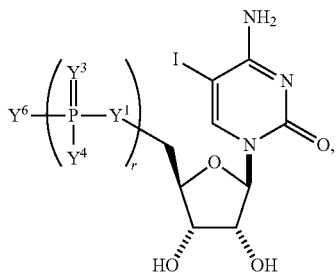

(BB-127)
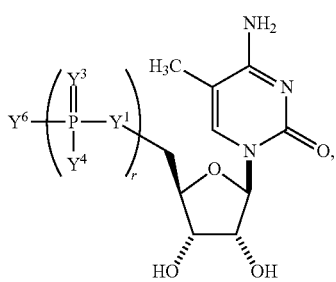

(BB-128)
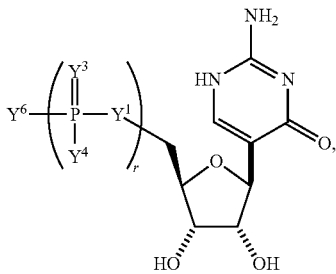

129
-continued
(BB-129)
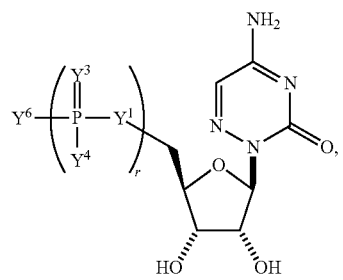
(BB-130)
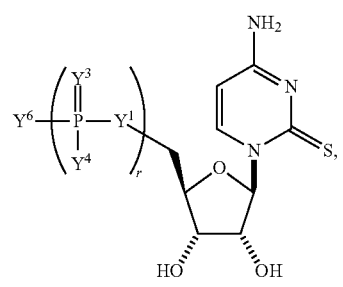
(BB-131)
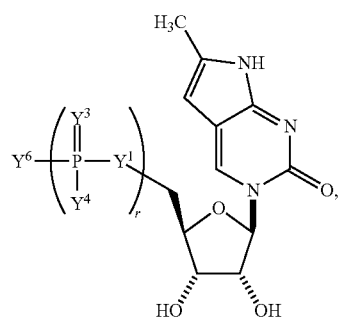
(BB-132)
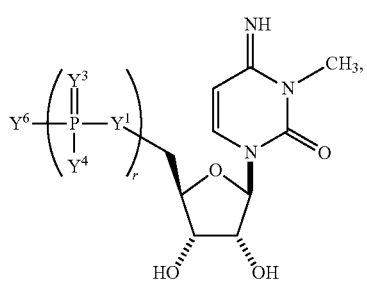
(BB-133)
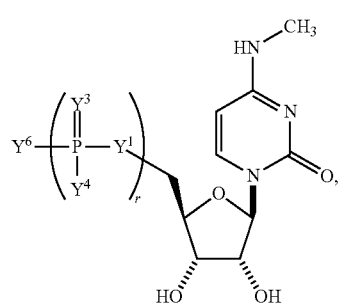
130
-continued
(BB-134)
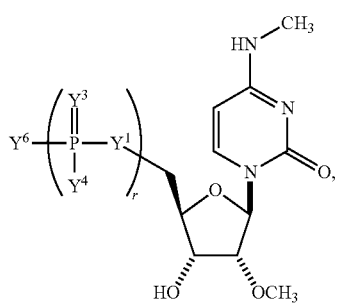
(BB-135)
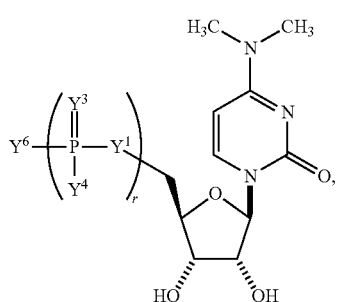
(BB-136)
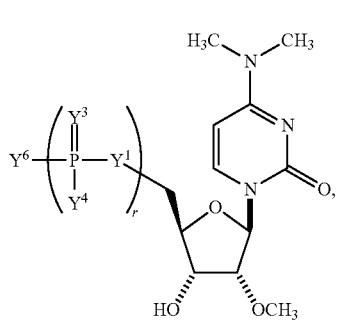
(BB-137)
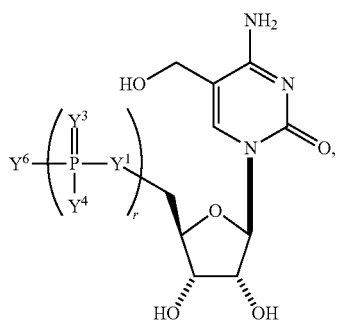
(BB-138)
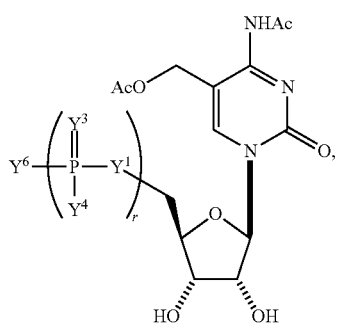

131
-continued
(BB-139)
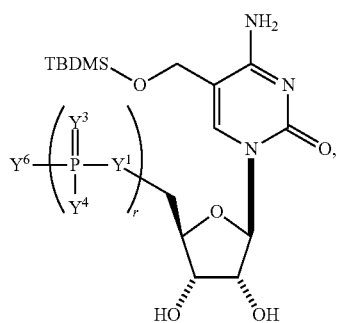
(BB-140)
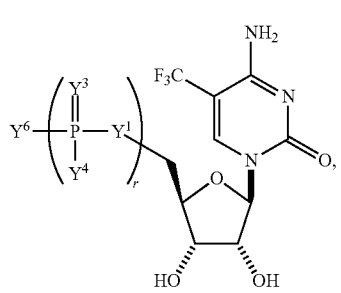
(BB-141)
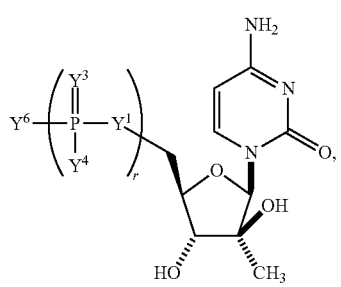
(BB-142)
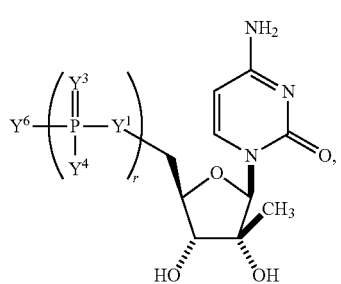
(BB-143)
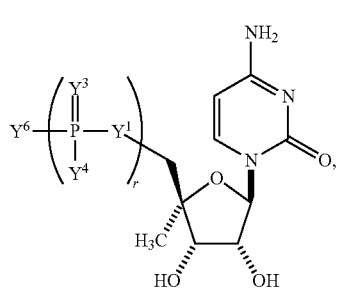
132
-continued
(BB-144)
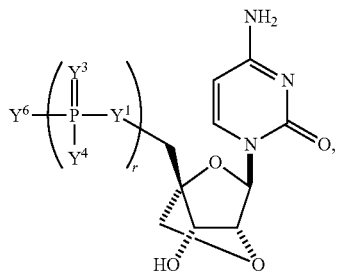
(BB-145)
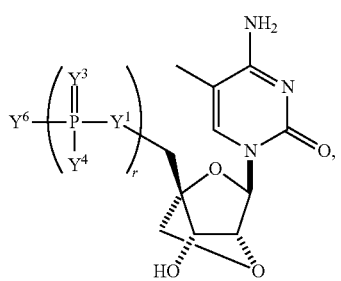
(BB-146)
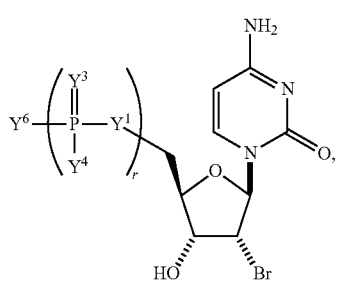
(BB-147)
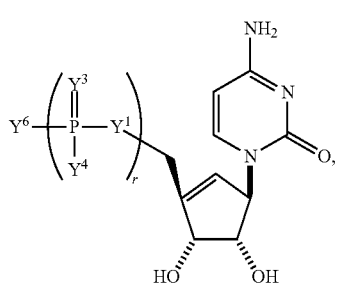
(BB-148)
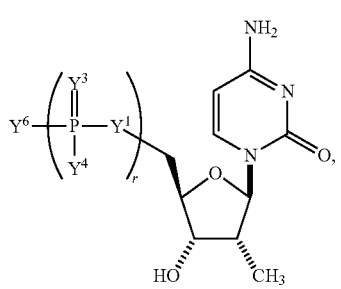

-continued
(BB-149)
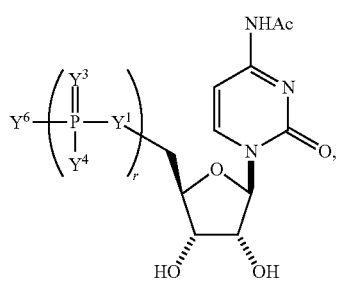
(BB-150)
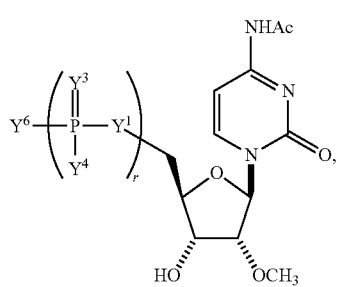
(BB-151)
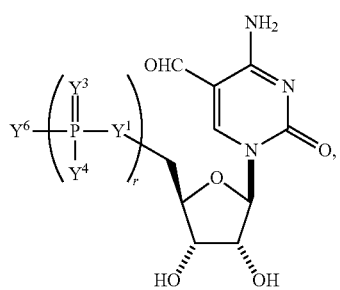
(BB-152)
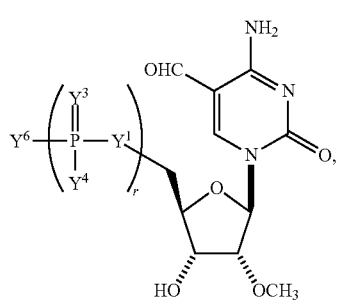
(BB-153)
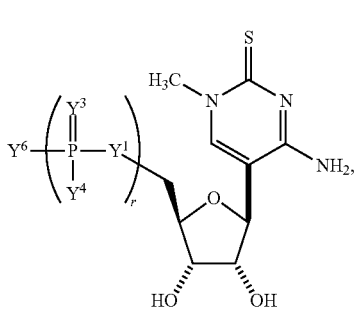
-continued
(BB-154)
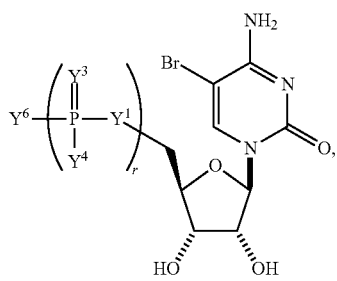
(BB-155)
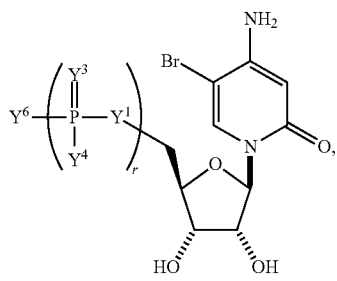
(BB-156)
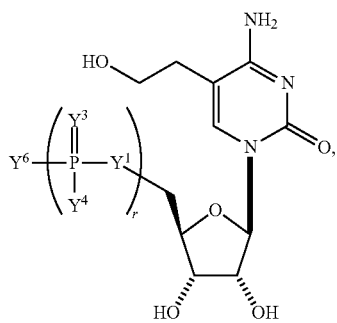
(BB-157)
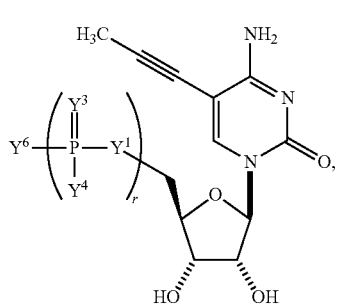
(BB-158)
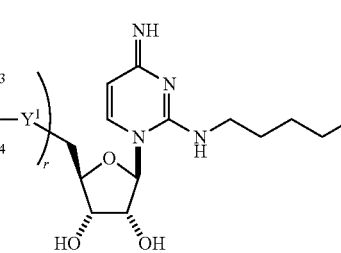

(BB-159)

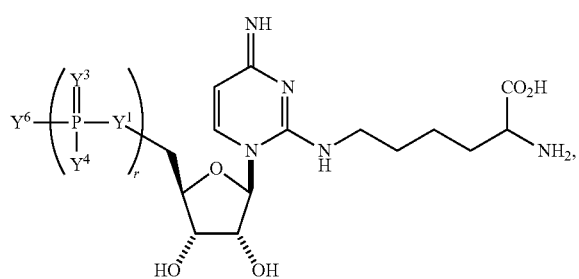

or a pharmaceutically acceptable salt or stereoisomer thereof, wherein $Y^1$, $Y^3$, $Y^4$, $Y^6$, and r are as described herein (e.g., each r is, independently, an integer from 0 to 5, such as from 0 to 3, from 1 to 3, or from 1 to 5)). For example, the building block molecule, which may be incorporated into a polynucleotide, primary construct, or mmRNA, can be:

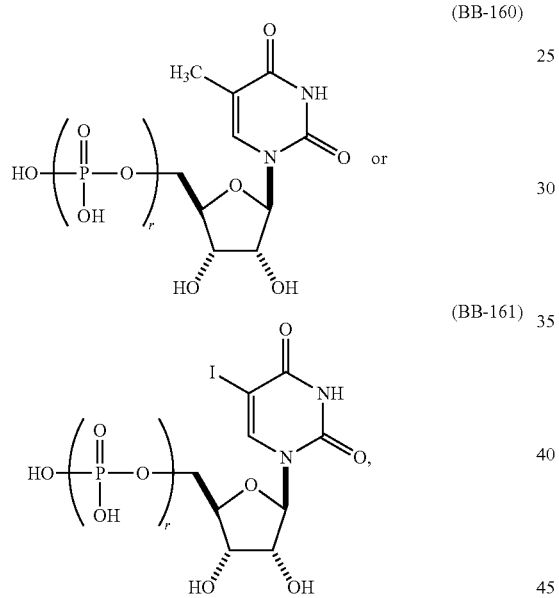

(BB-160)

(BB-161)

or a pharmaceutically acceptable salt or stereoisomer thereof, wherein each r is, independently, an integer from 0 to 5 (e.g., from 0 to 3, from 1 to 3, or from 1 to 5).

In some embodiments, the building block molecule, which may be incorporated into a polynucleotide, primary construct, or mmRNA, is a modified adenosine (e.g., selected from the group consisting of:

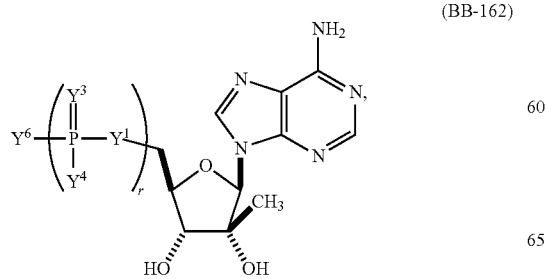

(BB-162)

(BB-163)

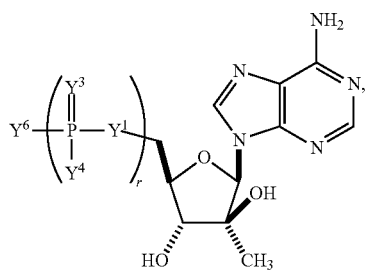

(BB-164)

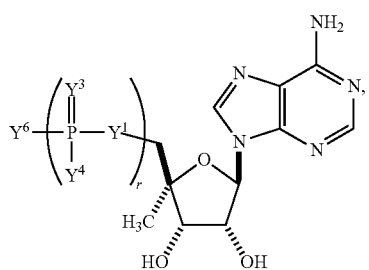

(BB-165)

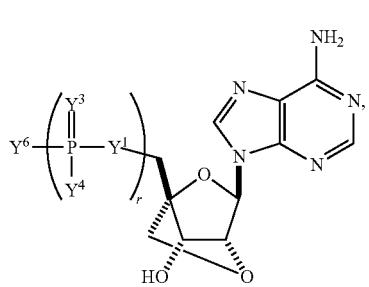

(BB-166)

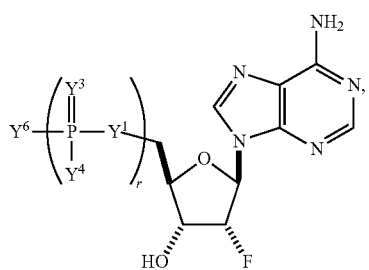

(BB-167)

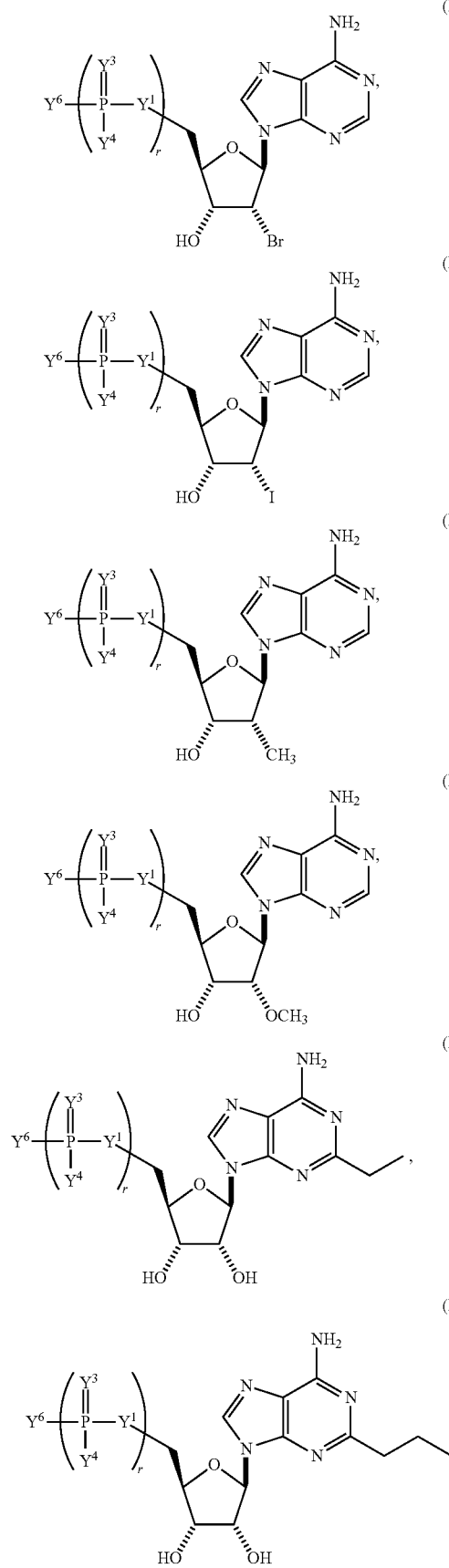
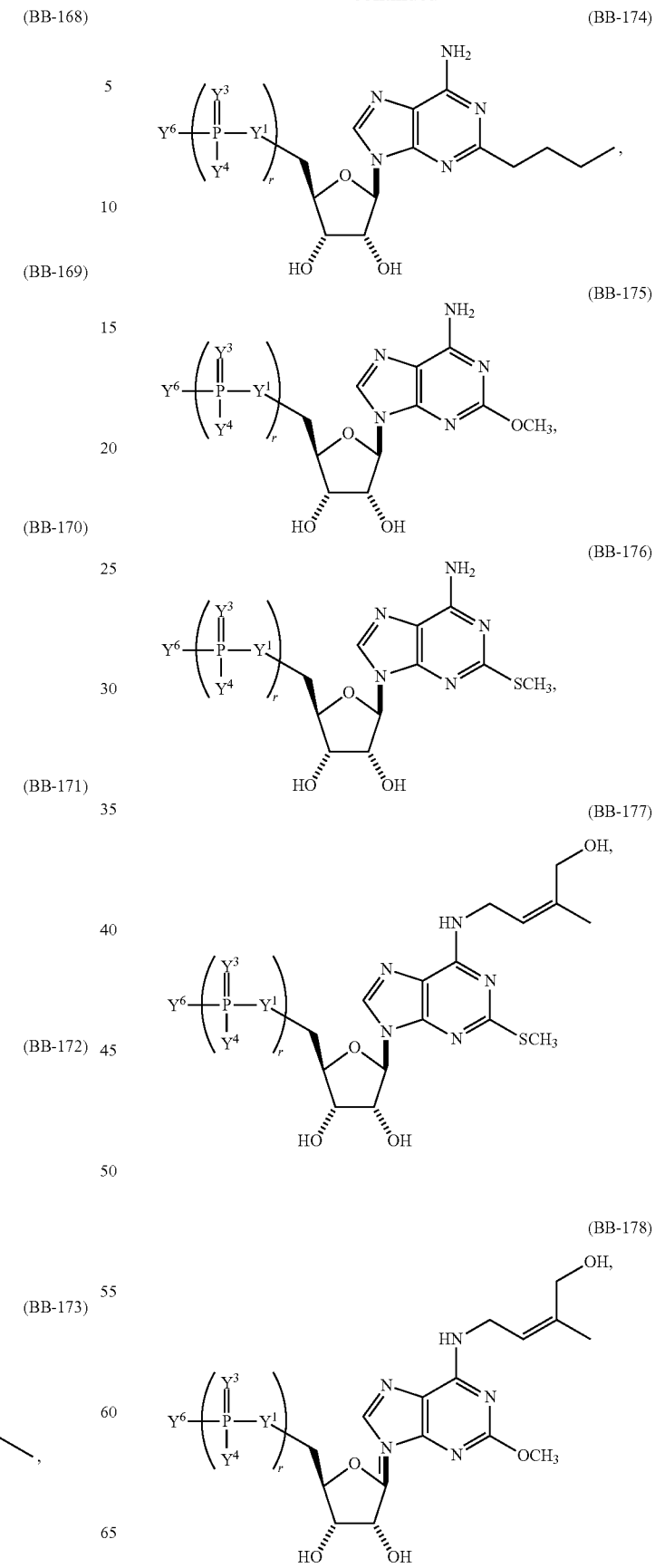

(BB-179)
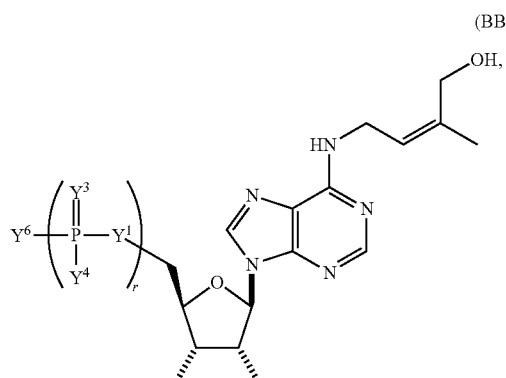
(BB-180)
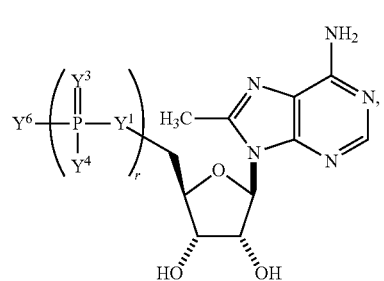
(BB-181)
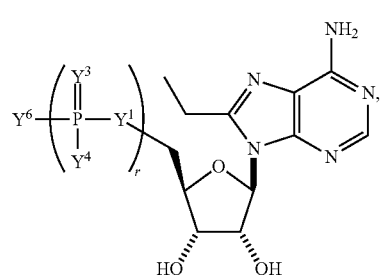
(BB-182)
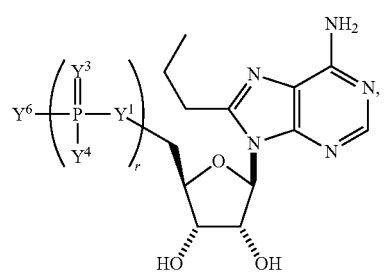
(BB-183)
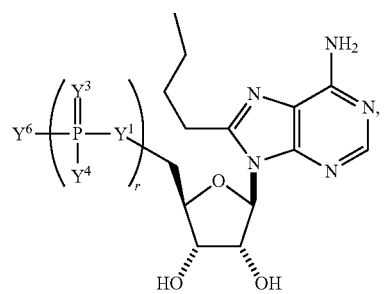
(BB-184)
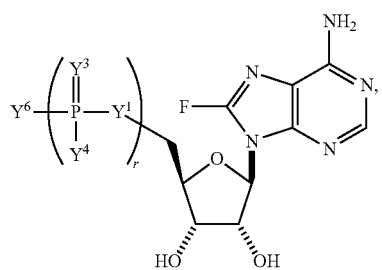
(BB-185)
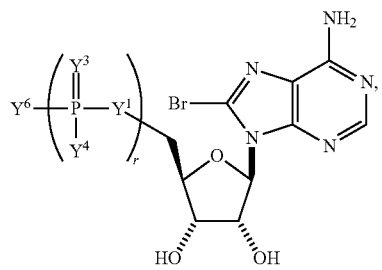
(BB-186)
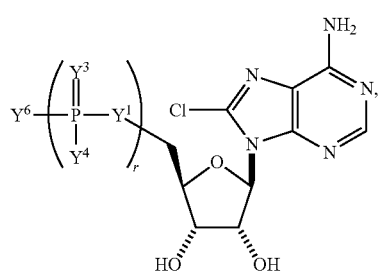
(BB-187)
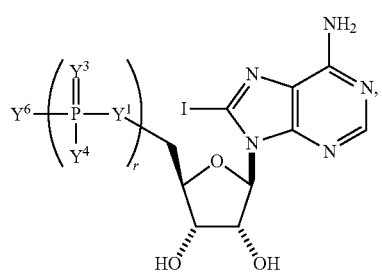
(BB-188)
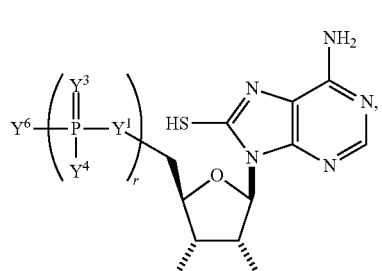
(BB-189)
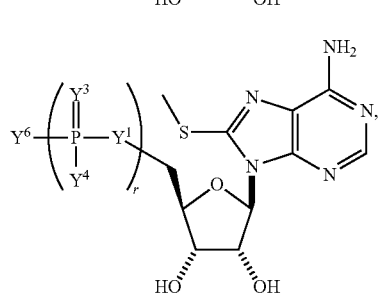

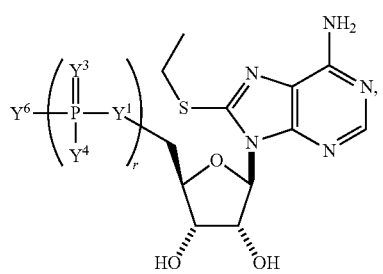 (BB-190)
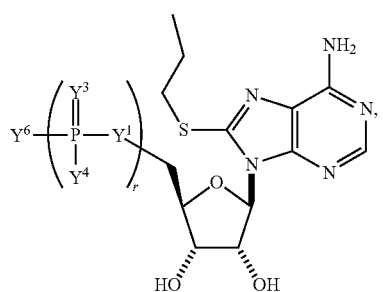 (BB-191)
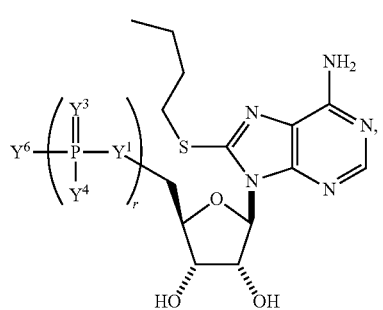 (BB-192)
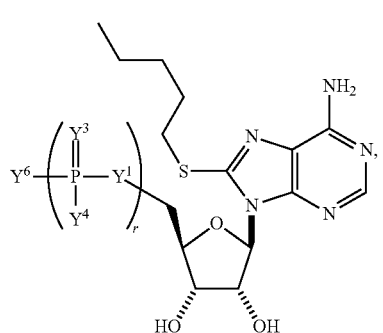 (BB-193)
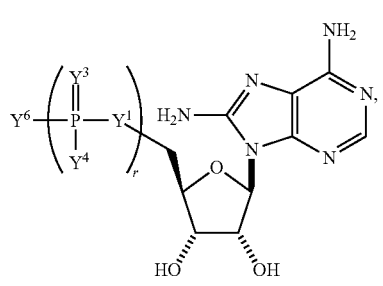 (BB-194)
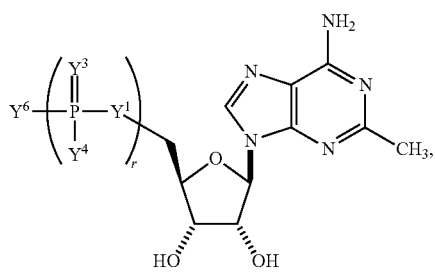 (BB-195)
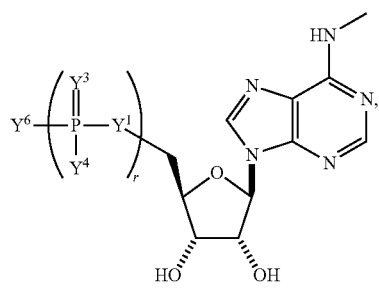 (BB-196)
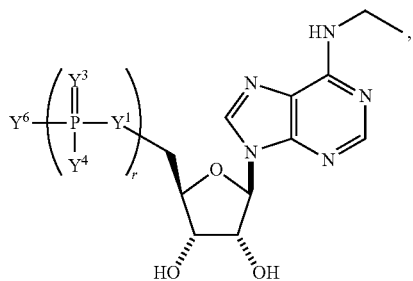 (BB-197)
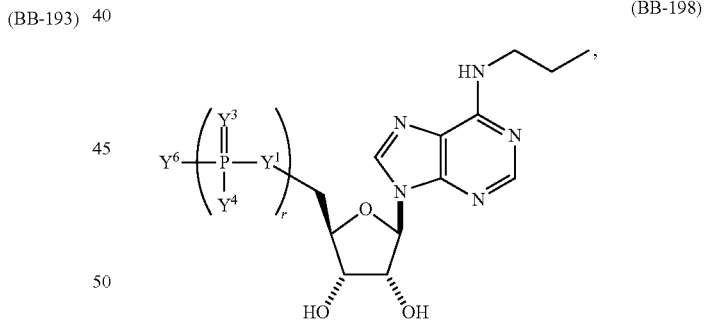 (BB-198)
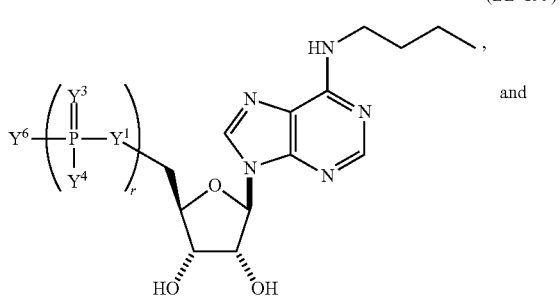 (BB-199)
and

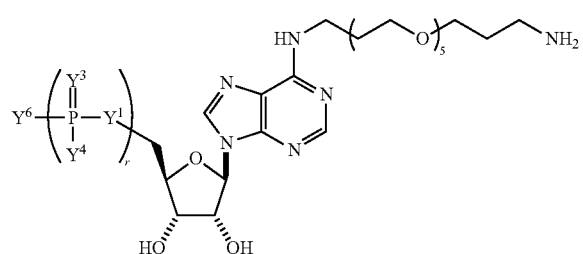
(BB-200)

or a pharmaceutically acceptable salt or stereoisomer thereof, wherein $Y^1$, $Y^3$, $Y^4$, $Y^6$, and r are as described herein (e.g., each r is, independently, an integer from 0 to 5, such as from 0 to 3, from 1 to 3, or from 1 to 5)).

In some embodiments, the building block molecule, which may be incorporated into a polynucleotide, primary construct, or mmRNA, is a modified guanosine (e.g., selected from the group consisting of:

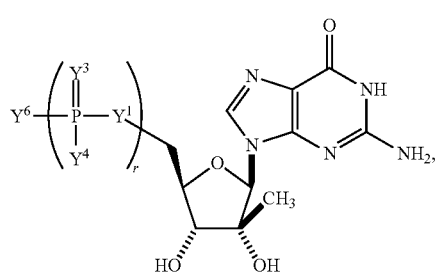
(BB-201)

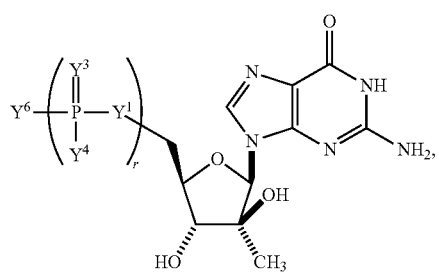
(BB-202)

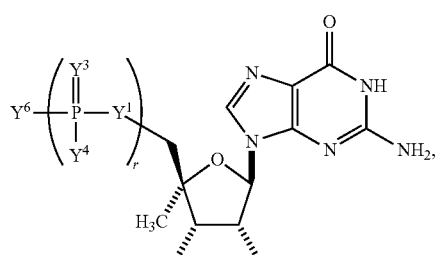
(BB-203)

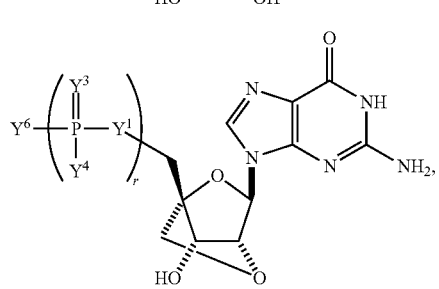
(BB-204)

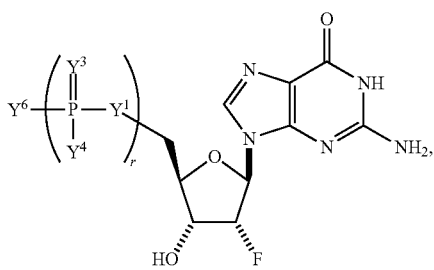
(BB-205)

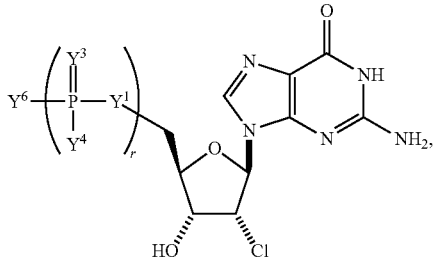
(BB-206)

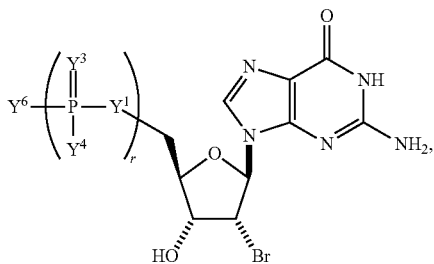
(BB-207)

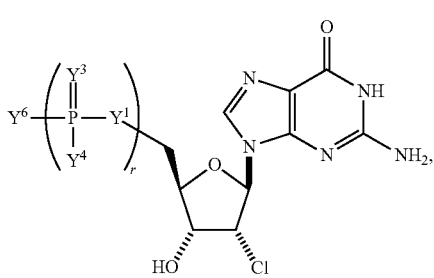
(BB-208)

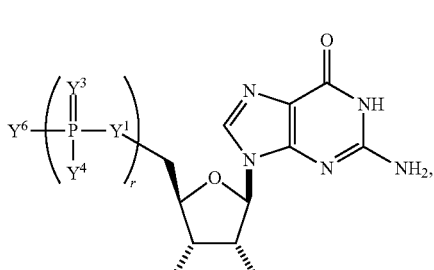
(BB-209)

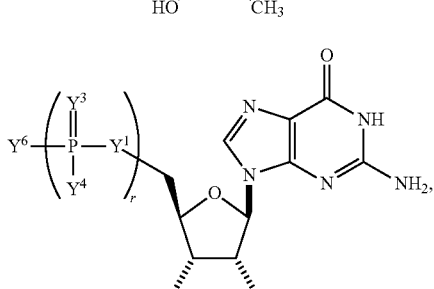
(BB-210)

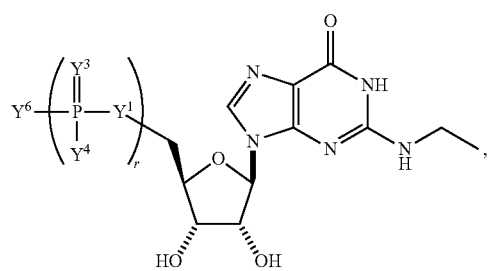
(BB-211)
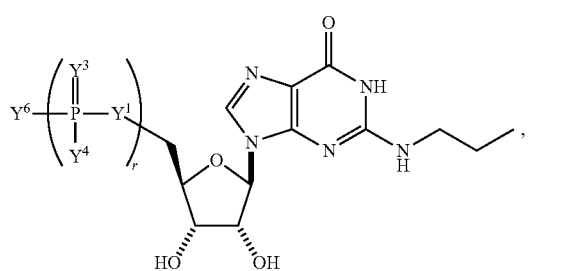
(BB-212)
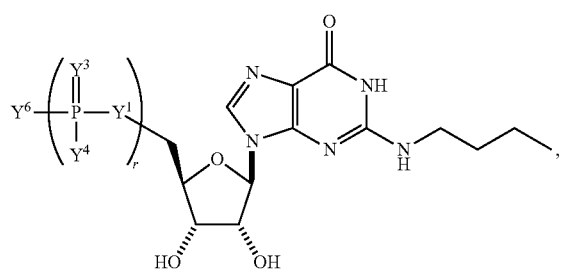
(BB-213)
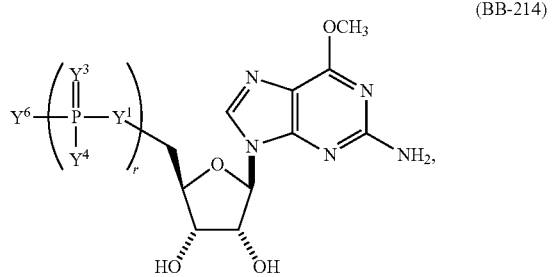
(BB-214)
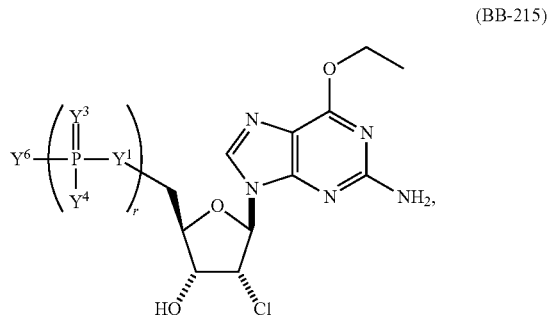
(BB-215)
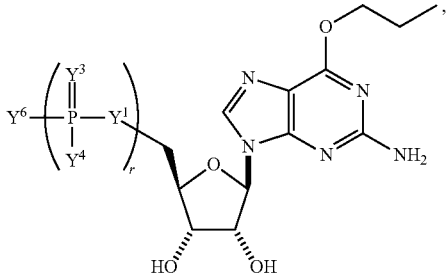
(BB-216)
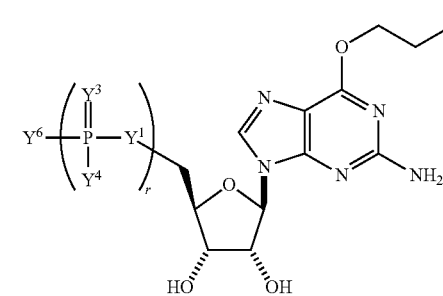
(BB-217)
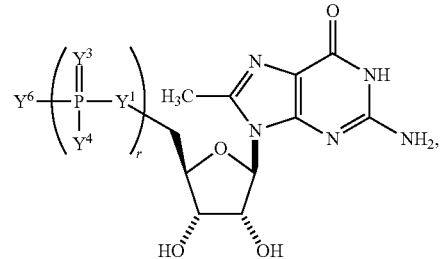
(BB-218)
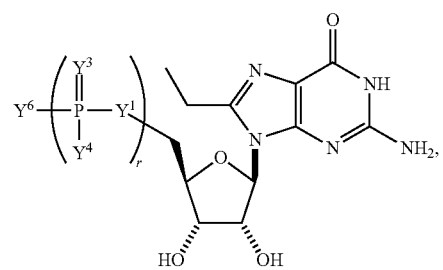
(BB-219)
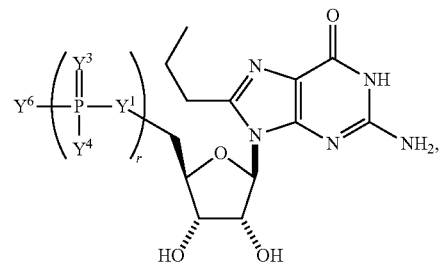
(BB-220)

(BB-221)
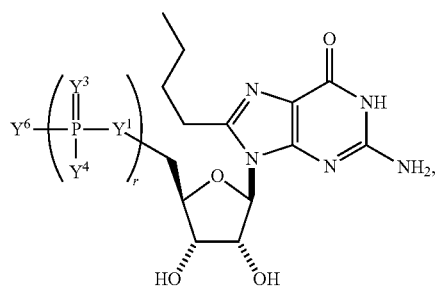
(BB-222)
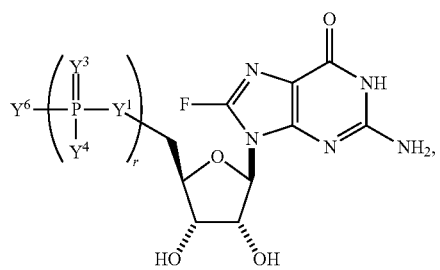
(BB-223)
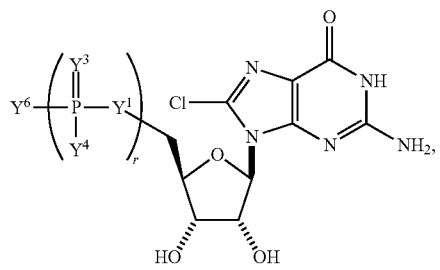
(BB-224)
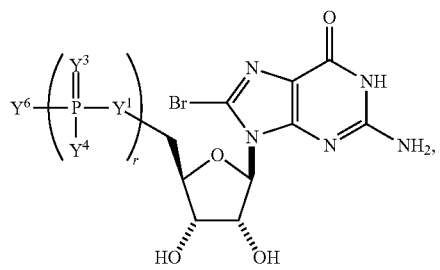
(BB-225)
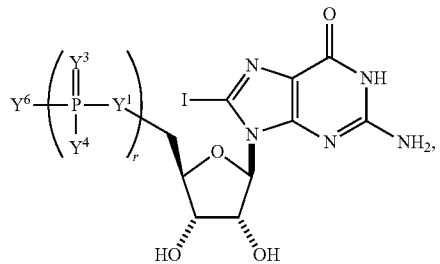
(BB-226)
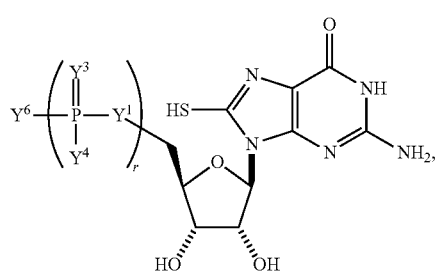
(BB-227)
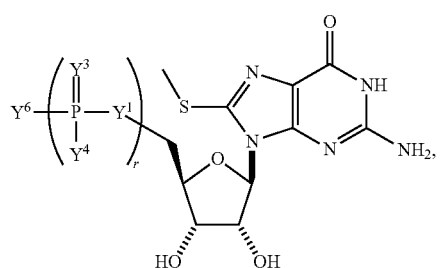
(BB-228)
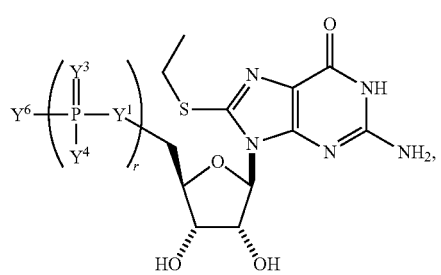
(BB-229)
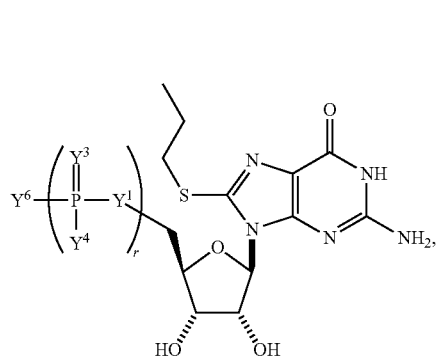
(BB-230)
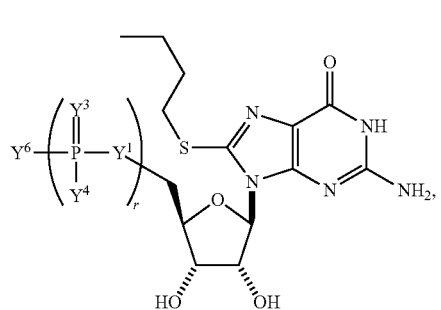
(BB-231)
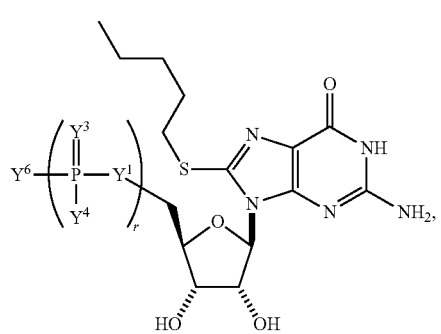

(BB-232)
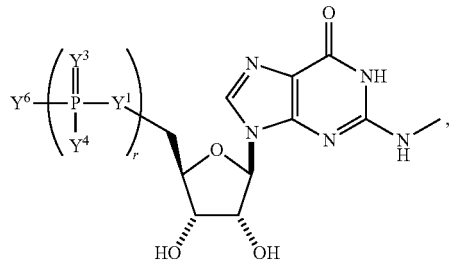

(BB-233)
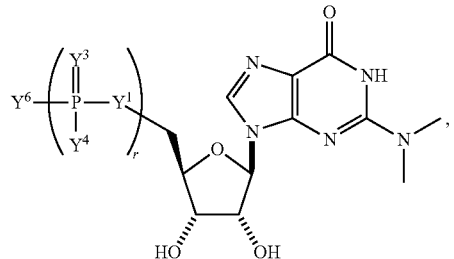

(BB-234)
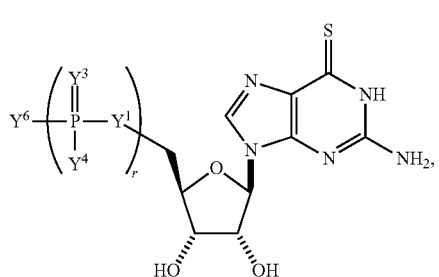

(BB-235)
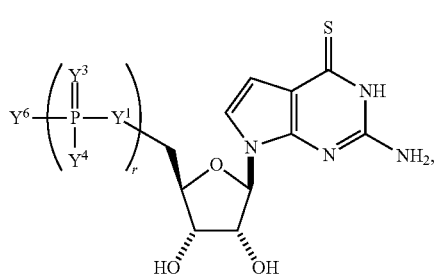

(BB-236)
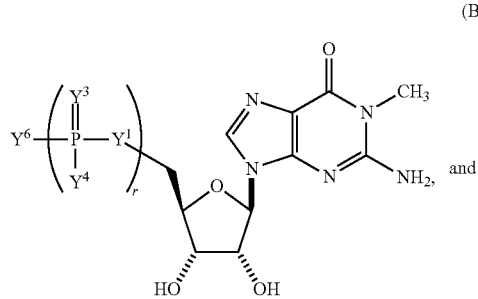
and (BB-237)
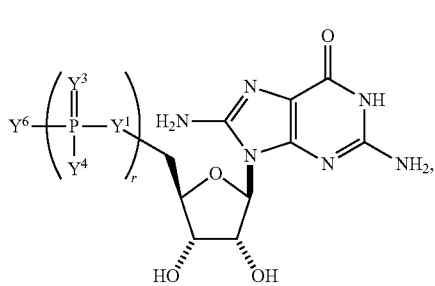

or a pharmaceutically acceptable salt or stereoisomer thereof, wherein $Y^1$, $Y^3$, $Y^4$, $Y^6$, and r are as described herein (e.g., each r is, independently, an integer from 0 to 5, such as from 0 to 3, from 1 to 3, or from 1 to 5)).

In some embodiments, the chemical modification can include replacement of C group at C-5 of the ring (e.g., for a pyrimidine nucleoside, such as cytosine or uracil) with N (e.g., replacement of the >CH group at C-5 with >NR$^{N1}$ group, wherein R$^{N1}$ is H or optionally substituted alkyl). For example, the building block molecule, which may be incorporated into a polynucleotide, primary construct, or mmRNA, can be:

(BB-238)
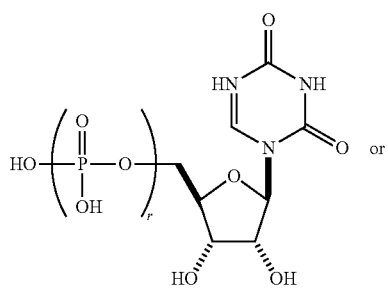
or (BB-239)
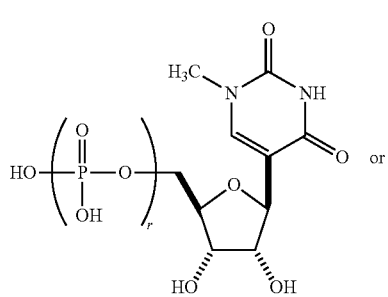
or (BB-240)
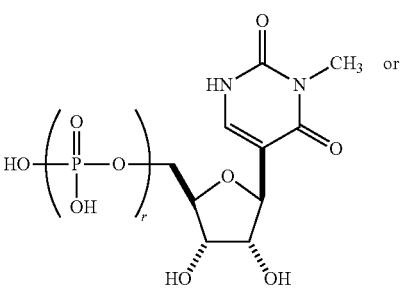

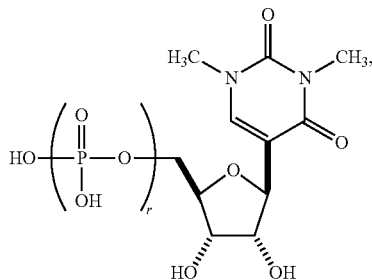

(BB-241)

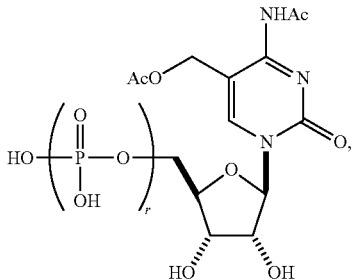

(BB-245)

or a pharmaceutically acceptable salt or stereoisomer thereof, wherein each r is, independently, an integer from 0 to 5 (e.g., from 0 to 3, from 1 to 3, or from 1 to 5).

In another embodiment, the chemical modification can include replacement of the hydrogen at C-5 of cytosine with halo (e.g., Br, Cl, F, or I) or optionally substituted alkyl (e.g., methyl). For example, the building block molecule, which may be incorporated into a polynucleotide, primary construct, or mmRNA, can be:

or a pharmaceutically acceptable salt or stereoisomer thereof, wherein each r is, independently, an integer from 0 to 5 (e.g., from 0 to 3, from 1 to 3, or from 1 to 5).

In yet a further embodiment, the chemical modification can include a fused ring that is formed by the $NH_2$ at the C-4 position and the carbon atom at the C-5 position. For example, the building block molecule, which may be incorporated into a polynucleotide, primary construct, or mmRNA, can be:

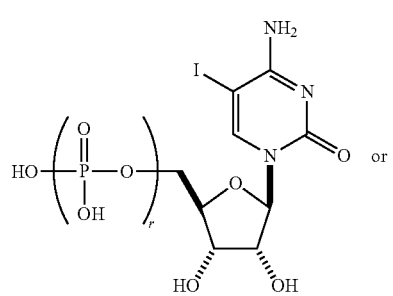

(BB-242)

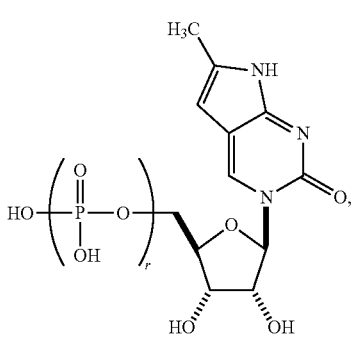

(BB-246)

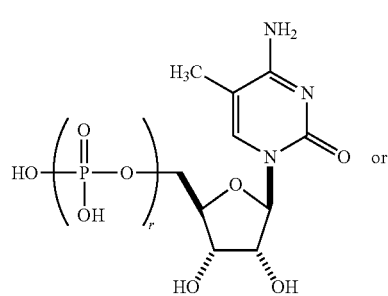

(BB-243)

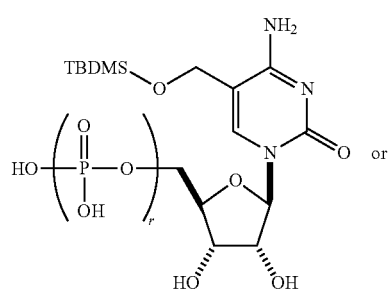

(BB-244)

or a pharmaceutically acceptable salt or stereoisomer thereof, wherein each r is, independently, an integer from 0 to 5 (e.g., from 0 to 3, from 1 to 3, or from 1 to 5).

Modifications on the Sugar

The modified nucleosides and nucleotides (e.g., building block molecules), which may be incorporated into a polynucleotide, primary construct, or mmRNA (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), $—O(CH_2CH_2O)_nCH_2CH_2OR$, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-aminoethyl-glycine linkages replace the ribose and phosphodiester backbone). The sugar group can also contain one or more carbons that possess the opposite stereochemical configuration than that of the corresponding carbon in ribose. Thus, a polynucleotide, primary construct, or mmRNA molecule can include nucleotides containing, e.g., arabinose, as the sugar.

Modifications on the Nucleobase

The present disclosure provides for modified nucleosides and nucleotides. As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group. The modified nucleotides may by synthesized by any useful method, as described herein (e.g., chemically, enzymatically, or recombinantly to include one or more modified or non-natural nucleosides).

The modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil.

The modified nucleosides and nucleotides can include a modified nucleobase. Examples of nucleobases found in RNA include, but are not limited to, adenine, guanine, cytosine, and uracil. Examples of nucleobase found in DNA include, but are not limited to, adenine, guanine, cytosine, and thymine. These nucleobases can be modified or wholly replaced to provide oncology-related polynucleotides, primary constructs, or mmRNA molecules having enhanced properties, e.g., resistance to nucleases through disruption of the binding of a major groove binding partner. Table 9 below identifies the chemical faces of each canonical nucleotide. Circles identify the atoms comprising the respective chemical regions.

TABLE 9

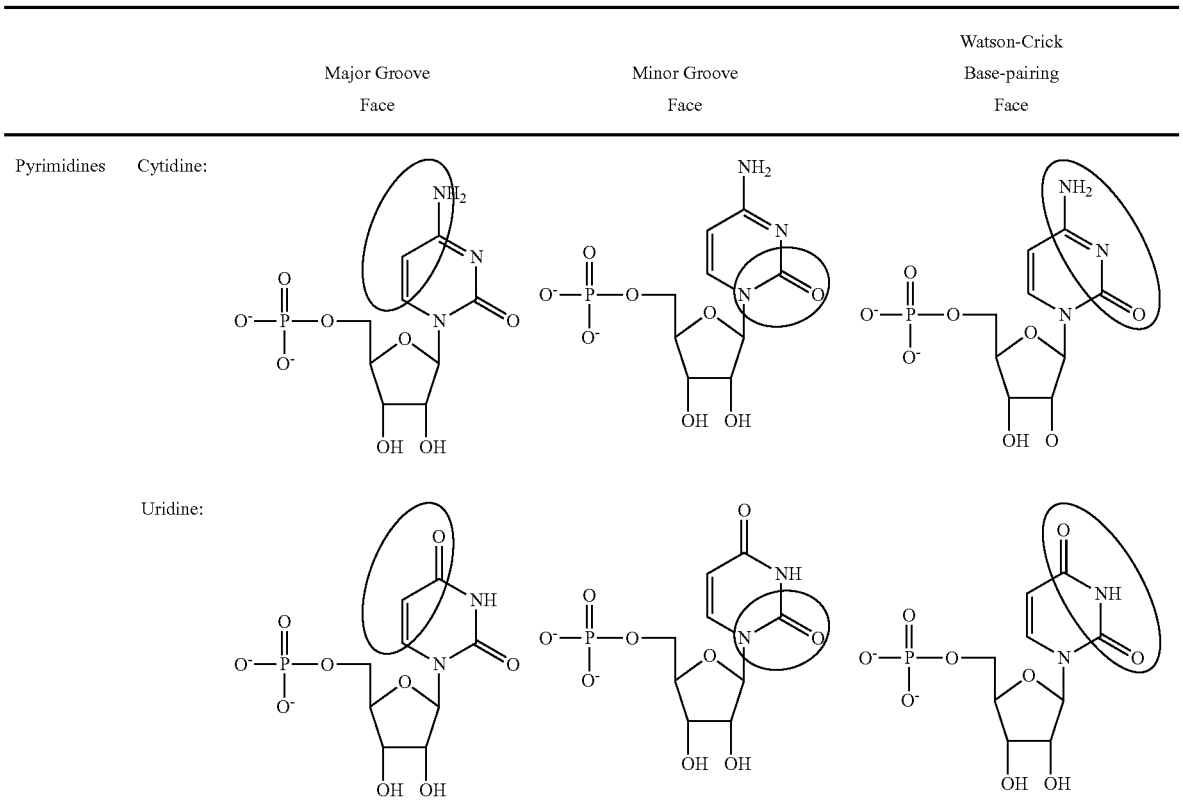

TABLE 9-continued

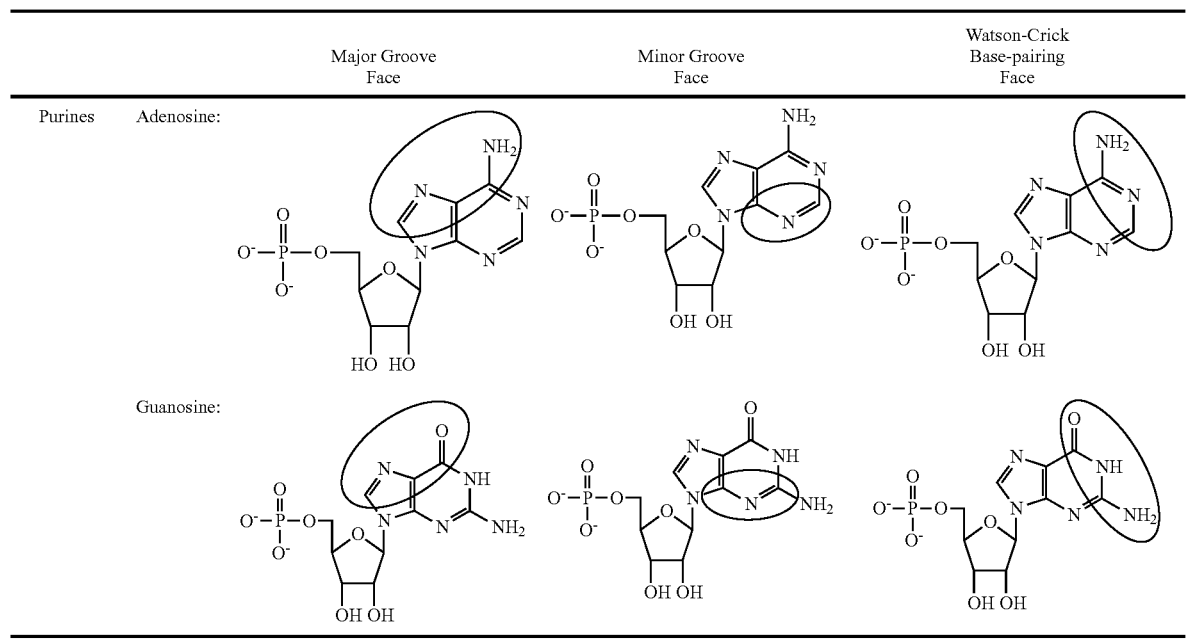

| | Major Groove Face | Minor Groove Face | Watson-Crick Base-pairing Face |
|---|---|---|---|
| Purines Adenosine: | | | |
| Guanosine: | | | |

In some embodiments, B is a modified uracil. Exemplary modified uracils include those having Formula (b1)-(b5):

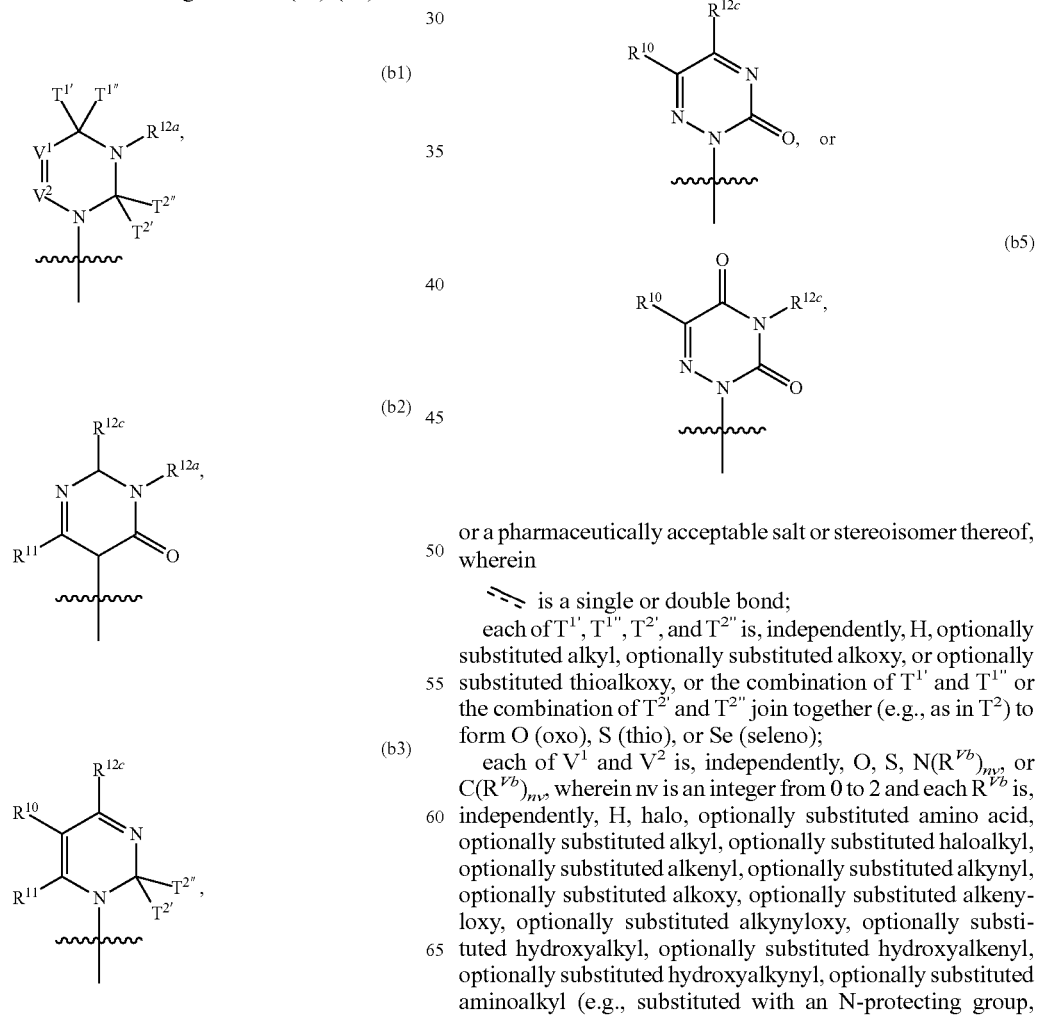

or a pharmaceutically acceptable salt or stereoisomer thereof, wherein

⇌ is a single or double bond;

each of $T^{1'}$, $T^{1''}$, $T^{2'}$, and $T^{2''}$ is, independently, H, optionally substituted alkyl, optionally substituted alkoxy, or optionally substituted thioalkoxy, or the combination of $T^{1'}$ and $T^{1''}$ or the combination of $T^{2'}$ and $T^{2''}$ join together (e.g., as in $T^2$) to form O (oxo), S (thio), or Se (seleno);

each of $V^1$ and $V^2$ is, independently, O, S, $N(R^{Vb})_{nv}$, or $C(R^{Vb})_{nv}$, wherein nv is an integer from 0 to 2 and each $R^{Vb}$ is, independently, H, halo, optionally substituted amino acid, optionally substituted alkyl, optionally substituted haloalkyl, optionally substituted alkenyl, optionally substituted alkynyl, optionally substituted alkoxy, optionally substituted alkenyloxy, optionally substituted alkynyloxy, optionally substituted hydroxyalkyl, optionally substituted hydroxyalkenyl, optionally substituted hydroxyalkynyl, optionally substituted aminoalkyl (e.g., substituted with an N-protecting group, such as any described herein, e.g., trifluoroacetyl), optionally substituted aminoalkenyl, optionally substituted aminoalkynyl, optionally substituted acylaminoalkyl (e.g., substituted with an N-protecting group, such as any described herein, e.g., trifluoroacetyl), optionally substituted alkoxycarbonylalkyl, optionally substituted alkoxycarbonylalkenyl, optionally substituted alkoxycarbonylalkynyl, or optionally substituted alkynyloxy (e.g., optionally substituted with any substituent described herein, such as those selected from (1)-(21) for alkyl);

$R^{10}$ is H, halo, optionally substituted amino acid, hydroxy, optionally substituted alkyl, optionally substituted alkenyl, optionally substituted alkynyl, optionally substituted aminoalkyl, optionally substituted hydroxyalkyl, optionally substituted hydroxyalkenyl, optionally substituted hydroxyalkynyl, optionally substituted aminoalkenyl, optionally substituted aminoalkynyl, optionally substituted alkoxy, optionally substituted alkoxycarbonylalkyl, optionally substituted alkoxycarbonylalkenyl, optionally substituted alkoxycarbonylalkynyl, optionally substituted alkoxycarbonylalkoxy, optionally substituted carboxyalkoxy, optionally substituted carboxyalkyl, or optionally substituted carbamoylalkyl;

$R^{11}$ is H or optionally substituted alkyl;

$R^{12a}$ is H, optionally substituted alkyl, optionally substituted hydroxyalkyl, optionally substituted hydroxyalkenyl, optionally substituted hydroxyalkynyl, optionally substituted aminoalkyl, optionally substituted aminoalkenyl, or optionally substituted aminoalkynyl, optionally substituted carboxyalkyl (e.g., optionally substituted with hydroxy), optionally substituted carboxyalkoxy, optionally substituted carboxyaminoalkyl, or optionally substituted carbamoylalkyl; and $R^{12c}$ is H, halo, optionally substituted alkyl, optionally substituted alkoxy, optionally substituted thioalkoxy, optionally substituted amino, optionally substituted hydroxyalkyl, optionally substituted hydroxyalkenyl, optionally substituted hydroxyalkynyl, optionally substituted aminoalkyl, optionally substituted aminoalkenyl, or optionally substituted aminoalkynyl.

Other exemplary modified uracils include those having Formula (b6)-(b9):

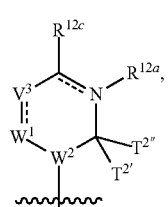

(b6)

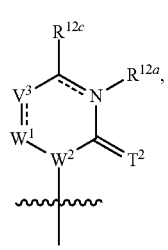

(b7)

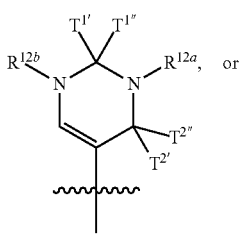

(b8)

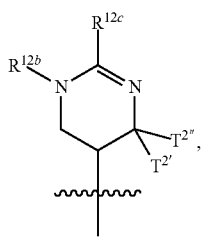

(b9)

or a pharmaceutically acceptable salt or stereoisomer thereof, wherein

⇌ is a single or double bond;

each of $T^{1'}$, $T^{1''}$, $T^{2'}$, and $T^{2''}$ is, independently, H, optionally substituted alkyl, optionally substituted alkoxy, or optionally substituted thioalkoxy, or the combination of $T^{1'}$ and $T^{1''}$ join together (e.g., as in $T^1$) or the combination of $T^{2'}$ and $T^{2''}$ join together (e.g., as in $T^2$) to form O (oxo), S (thio), or Se (seleno), or each $T^1$ and $T^2$ is, independently, O (oxo), S (thio), or Se (seleno);

each of $W^1$ and $W^2$ is, independently, $N(R^{Wa})_{nw}$ or $C(R^{Wa})_{nw}$, wherein nw is an integer from 0 to 2 and each $R^{Wa}$ is, independently, H, optionally substituted alkyl, or optionally substituted alkoxy;

each $V^3$ is, independently, O, S, $N(R^{Va})_{nv}$, or $C(R^{Va})_{nv}$, wherein nv is an integer from 0 to 2 and each $R^{Va}$ is, independently, H, halo, optionally substituted amino acid, optionally substituted alkyl, optionally substituted hydroxyalkyl, optionally substituted hydroxyalkenyl, optionally substituted hydroxyalkynyl, optionally substituted alkenyl, optionally substituted alkynyl, optionally substituted heterocyclyl, optionally substituted alkheterocyclyl, optionally substituted alkoxy, optionally substituted alkenyloxy, or optionally substituted alkynyloxy, optionally substituted aminoalkyl (e.g., substituted with an N-protecting group, such as any described herein, e.g., trifluoroacetyl, or sulfoalkyl), optionally substituted aminoalkenyl, optionally substituted aminoalkynyl, optionally substituted acylaminoalkyl (e.g., substituted with an N-protecting group, such as any described herein, e.g., trifluoroacetyl), optionally substituted alkoxycarbonylalkyl, optionally substituted alkoxycarbonylalkenyl, optionally substituted alkoxycarbonylalkynyl, optionally substituted alkoxycarbonylacyl, optionally substituted alkoxycarbonylalkoxy, optionally substituted carboxyalkyl (e.g., optionally substituted with hydroxy and/or an O-protecting group), optionally substituted carboxyalkoxy, optionally substituted carboxyaminoalkyl, or optionally substituted carbamoylalkyl (e.g., optionally substituted with any substituent described herein, such as those selected from (1)-(21) for alkyl), and wherein $R^{Va}$ and $R^{12c}$ taken together with the carbon atoms to which they are attached can form optionally substituted cycloalkyl, optionally substituted aryl, or optionally substituted heterocyclyl (e.g., a 5- or 6-membered ring);

$R^{12a}$ is H, optionally substituted alkyl, optionally substituted hydroxyalkyl, optionally substituted hydroxyalkenyl, optionally substituted hydroxyalkynyl, optionally substituted aminoalkyl, optionally substituted aminoalkenyl, optionally substituted aminoalkynyl, optionally substituted carboxyalkyl (e.g., optionally substituted with hydroxy and/or an O-protecting group), optionally substituted carboxyalkoxy, optionally substituted carboxyaminoalkyl, optionally substituted carbamoylalkyl, or absent;

$R^{12b}$ is H, optionally substituted alkyl, optionally substituted alkenyl, optionally substituted alkynyl, optionally substituted hydroxyalkyl, optionally substituted hydroxyalkenyl, optionally substituted hydroxyalkynyl, optionally substituted aminoalkyl, optionally substituted aminoalkenyl, optionally substituted aminoalkynyl, optionally substituted alkaryl, optionally substituted heterocyclyl, optionally substituted alkheterocyclyl, optionally substituted amino acid, optionally substituted alkoxycarbonylacyl, optionally substituted alkoxycarbonylalkoxy, optionally substituted alkoxycarbonylalkyl, optionally substituted alkoxycarbonylalkenyl, optionally substituted alkoxycarbonylalkynyl, optionally substituted alkoxycarbonylalkoxy, optionally substituted carboxyalkyl (e.g., optionally substituted with hydroxy and/or an O-protecting group), optionally substituted carboxyalkoxy, optionally substituted carboxyaminoalkyl, or optionally substituted carbamoylalkyl, wherein the combination of $R^{12b}$ and $T^{1'}$ or the combination of $R^{12b}$ and $R^{12c}$ can join together to form optionally substituted heterocyclyl; and $R^{12c}$ is H, halo, optionally substituted alkyl, optionally substituted alkoxy, optionally substituted thioalkoxy, optionally substituted amino, optionally substituted aminoalkyl, optionally substituted aminoalkenyl, or optionally substituted aminoalkynyl.

Further exemplary modified uracils include those having Formula (b28)-(b31):

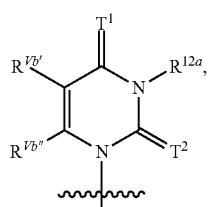

(b28)

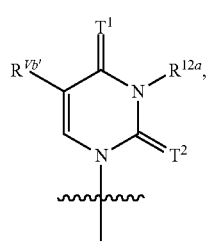

(b29)

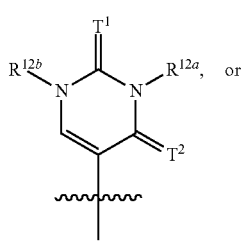

(b30)

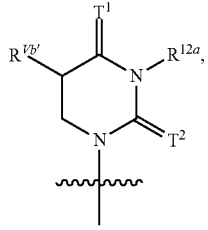

(b31)

or a pharmaceutically acceptable salt or stereoisomer thereof, wherein each of $T^1$ and $T^2$ is, independently, O (oxo), S (thio), or Se (seleno);

each $R^{Vb'}$ and $R^{Vb''}$ is, independently, H, halo, optionally substituted amino acid, optionally substituted alkyl, optionally substituted haloalkyl, optionally substituted hydroxyalkyl, optionally substituted hydroxyalkenyl, optionally substituted hydroxyalkynyl, optionally substituted alkenyl, optionally substituted alkynyl, optionally substituted alkoxy, optionally substituted alkenyloxy, optionally substituted alkynyloxy, optionally substituted aminoalkyl (e.g., substituted with an N-protecting group, such as any described herein, e.g., trifluoroacetyl, or sulfoalkyl), optionally substituted aminoalkenyl, optionally substituted aminoalkynyl, optionally substituted acylaminoalkyl (e.g., substituted with an N-protecting group, such as any described herein, e.g., trifluoroacetyl), optionally substituted alkoxycarbonylalkyl, optionally substituted alkoxycarbonylalkenyl, optionally substituted alkoxycarbonylalkynyl, optionally substituted alkoxycarbonylacyl, optionally substituted alkoxycarbonylalkoxy, optionally substituted carboxyalkyl (e.g., optionally substituted with hydroxy and/or an O-protecting group), optionally substituted carboxyalkoxy, optionally substituted carboxyaminoalkyl, or optionally substituted carbamoylalkyl (e.g., optionally substituted with any substituent described herein, such as those selected from (1)-(21) for alkyl) (e.g., $R^{Vb'}$ is optionally substituted alkyl, optionally substituted alkenyl, or optionally substituted aminoalkyl, e.g., substituted with an N-protecting group, such as any described herein, e.g., trifluoroacetyl, or sulfoalkyl);

$R^{12a}$ is H, optionally substituted alkyl, optionally substituted carboxyaminoalkyl, optionally substituted aminoalkyl (e.g., e.g., substituted with an N-protecting group, such as any described herein, e.g., trifluoroacetyl, or sulfoalkyl), optionally substituted aminoalkenyl, or optionally substituted aminoalkynyl; and $R^{12b}$ is H, optionally substituted alkyl, optionally substituted alkenyl, optionally substituted alkynyl, optionally substituted hydroxyalkyl, optionally substituted hydroxyalkenyl, optionally substituted hydroxyalkynyl, optionally substituted aminoalkyl, optionally substituted aminoalkenyl, optionally substituted aminoalkynyl (e.g., e.g., substituted with an N-protecting group, such as any described herein, e.g., trifluoroacetyl, or sulfoalkyl), optionally substituted alkoxycarbonylacyl, optionally substituted alkoxycarbonylalkoxy, optionally substituted alkoxycarbonylalkyl, optionally substituted alkoxycarbonylalkenyl, optionally substituted alkoxycarbonylalkynyl, optionally substituted alkoxycarbonylalkoxy, optionally substituted carboxyalkoxy, optionally substituted carboxyalkyl, or optionally substituted carbamoylalkyl.

In particular embodiments, $T^1$ is O (oxo), and $T^2$ is S (thio) or Se (seleno). In other embodiments, $T^1$ is S (thio), and $T^2$ is O (oxo) or Se (seleno). In some embodiments, $R^{Vb'}$ is H, optionally substituted alkyl, or optionally substituted alkoxy.

In other embodiments, each $R^{12a}$ and $R^{12b}$ is, independently, H, optionally substituted alkyl, optionally substituted alkenyl, optionally substituted alkynyl, or optionally substituted hydroxyalkyl. In particular embodiments, $R^{12a}$ is H. In other embodiments, both $R^{12a}$ and $R^{12b}$ are H.

In some embodiments, each $R^{Vb'}$ of $R^{12b}$ is, independently, optionally substituted aminoalkyl (e.g., substituted with an N-protecting group, such as any described herein, e.g., trifluoroacetyl, or sulfoalkyl), optionally substituted aminoalkenyl, optionally substituted aminoalkynyl, or optionally substituted acylaminoalkyl (e.g., substituted with an N-protecting group, such as any described herein, e.g., trifluoroacetyl). In some embodiments, the amino and/or alkyl of the optionally substituted aminoalkyl is substituted with one or more of optionally substituted alkyl, optionally substituted alkenyl, optionally substituted sulfoalkyl, optionally substituted carboxy (e.g., substituted with an O-protecting group), optionally substituted hydroxy (e.g., substituted with an O-protecting group), optionally substituted carboxyalkyl (e.g., substituted with an O-protecting group), optionally substituted alkoxycarbonylalkyl (e.g., substituted with an O-protecting group), or N-protecting group. In some embodiments, optionally substituted aminoalkyl is substituted with an optionally substituted sulfoalkyl or optionally substituted alkenyl. In particular embodiments, $R^{12a}$ and $R^{Vb''}$ are both H. In particular embodiments, $T^1$ is O (oxo), and $T^2$ is S (thio) or Se (seleno).

In some embodiments, $R^{Vb'}$ is optionally substituted alkoxycarbonylalkyl or optionally substituted carbamoylalkyl.

In particular embodiments, the optional substituent for $R^{12a}$, $R^{12b}$, $R^{12c}$, or $R^{Va}$ is a polyethylene glycol group (e.g., $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl); or an amino-polyethylene glycol group (e.g., $-NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl).

In some embodiments, B is a modified cytosine. Exemplary modified cytosines include compounds of Formula (b10)-(b14):

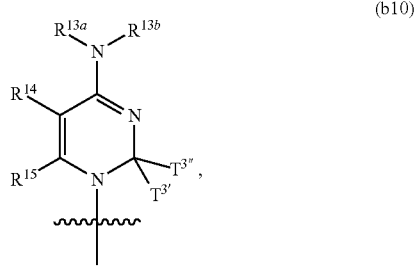
(b10)

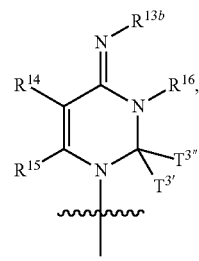
(b11)

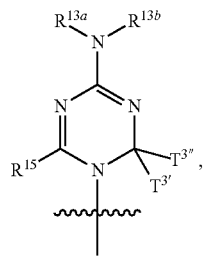
(b12)

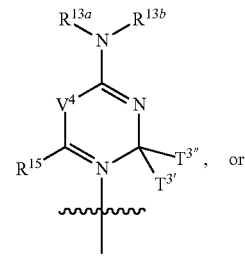
(b13)

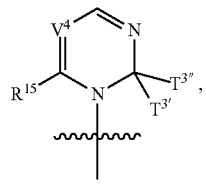
(b14)

or a pharmaceutically acceptable salt or stereoisomer thereof, wherein each of $T^{3'}$ and $T^{3''}$ is, independently, H, optionally substituted alkyl, optionally substituted alkoxy, or optionally substituted thioalkoxy, or the combination of $T^{3'}$ and $T^{3''}$ join together (e.g., as in $T^3$) to form O (oxo), S (thio), or Se (seleno);

each $V^4$ is, independently, O, S, $N(R^{Vc})_{nv}$, or $C(R^{Vc})_{nv}$, wherein nv is an integer from 0 to 2 and each $R^{Vc}$ is, independently, H, halo, optionally substituted amino acid, optionally substituted alkyl, optionally substituted alkenyl, optionally substituted alkynyl, optionally substituted alkoxy, optionally substituted alkenyloxy, optionally substituted heterocyclyl, optionally substituted alkheterocyclyl, or optionally substituted alkynyloxy (e.g., optionally substituted with any substituent described herein, such as those selected from (1)-(21) for alkyl), wherein the combination of $R^{13b}$ and $R^{Vc}$ can be taken together to form optionally substituted heterocyclyl;

each $V^5$ is, independently, $N(R^{Vd})_{nv}$, or $C(R^{Vd})_{nv}$, wherein nv is an integer from 0 to 2 and each $R^{Vd}$ is, independently, H, halo, optionally substituted amino acid, optionally substituted alkyl, optionally substituted alkenyl, optionally substituted alkynyl, optionally substituted alkoxy, optionally substituted alkenyloxy, optionally substituted heterocyclyl, optionally substituted alkheterocyclyl, or optionally substituted alkynyloxy (e.g., optionally substituted with any substituent described herein, such as those selected from (1)-(21) for alkyl) (e.g., $V^5$ is —CH or N);

each of $R^{13a}$ and $R^{13b}$ is, independently, H, optionally substituted acyl, optionally substituted acyloxyalkyl, optionally substituted alkyl, or optionally substituted alkoxy, wherein the combination of $R^{13b}$ and $R^{14}$ can be taken together to form optionally substituted heterocyclyl;

each $R^{14}$ is, independently, H, halo, hydroxy, thiol, optionally substituted acyl, optionally substituted amino acid, optionally substituted alkyl, optionally substituted haloalkyl, optionally substituted alkenyl, optionally substituted alkynyl, optionally substituted hydroxyalkyl (e.g., substituted with an O-protecting group), optionally substituted hydroxyalkenyl, optionally substituted hydroxyalkynyl, optionally substituted alkoxy, optionally substituted alkenyloxy, optionally substituted alkynyloxy, optionally substituted aminoalkoxy, optionally substituted alkoxyalkoxy, optionally substituted acyloxyalkyl, optionally substituted amino (e.g., —NHR, wherein R is H, alkyl, aryl, or phosphoryl), azido, optionally substituted aryl, optionally substituted heterocyclyl, optionally substituted alkheterocyclyl, optionally substituted aminoalkyl, optionally substituted aminoalkenyl, or optionally substituted aminoalkynyl; and each of $R^{15}$ and $R^{16}$ is, independently, H, optionally substituted alkyl, optionally substituted alkenyl, or optionally substituted alkynyl.

Further exemplary modified cytosines include those having Formula (b32)-(b35):

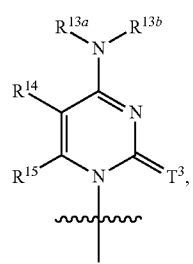
(b32)

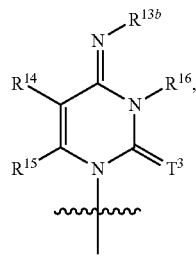
(b33)

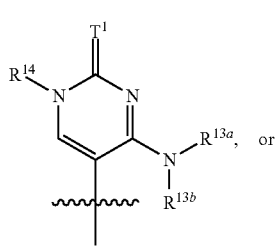
(b34), or

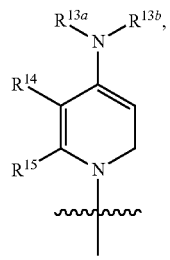
(b35)

or a pharmaceutically acceptable salt or stereoisomer thereof, wherein each of $T^1$ and $T^3$ is, independently, O (oxo), S (thio), or Se (seleno);

each of $R^{13a}$ and $R^{13b}$ is, independently, H, optionally substituted acyl, optionally substituted acyloxyalkyl, optionally substituted alkyl, or optionally substituted alkoxy, wherein the combination of $R^{13b}$ and $R^{14}$ can be taken together to form optionally substituted heterocyclyl;

each $R^{14}$ is, independently, H, halo, hydroxy, thiol, optionally substituted acyl, optionally substituted amino acid, optionally substituted alkyl, optionally substituted haloalkyl, optionally substituted alkenyl, optionally substituted alkynyl, optionally substituted hydroxyalkyl (e.g., substituted with an O-protecting group), optionally substituted hydroxyalkenyl, optionally substituted hydroxyalkynyl, optionally substituted alkoxy, optionally substituted alkenyloxy, optionally substituted alkynyloxy, optionally substituted aminoalkoxy, optionally substituted alkoxyalkoxy, optionally substituted acyloxyalkyl, optionally substituted amino (e.g., —NHR, wherein R is H, alkyl, aryl, or phosphoryl), azido, optionally substituted aryl, optionally substituted heterocyclyl, optionally substituted alkheterocyclyl, optionally substituted aminoalkyl (e.g., hydroxyalkyl, alkyl, alkenyl, or alkynyl), optionally substituted aminoalkenyl, or optionally substituted aminoalkynyl; and each of $R^{15}$ and $R^{16}$ is, independently, H, optionally substituted alkyl, optionally substituted alkenyl, or optionally substituted alkynyl (e.g., $R^{15}$ is H, and $R^{16}$ is H or optionally substituted alkyl).

In some embodiments, $R^{15}$ is H, and $R^{16}$ is H or optionally substituted alkyl. In particular embodiments, $R^{14}$ is H, acyl, or hydroxyalkyl. In some embodiments, $R^{14}$ is halo. In some embodiments, both $R^{14}$ and $R^{15}$ are H. In some embodiments, both $R^{15}$ and $R^{16}$ are H. In some embodiments, each of $R^{14}$ and $R^{15}$ and $R^{16}$ is H. In further embodiments, each of $R^{13a}$ and $R^{13b}$ is independently, H or optionally substituted alkyl.

Further non-limiting examples of modified cytosines include compounds of Formula (b36):

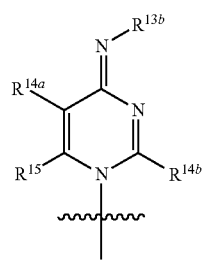
(b36)

or a pharmaceutically acceptable salt or stereoisomer thereof, wherein each $R^{13b}$ is, independently, H, optionally substituted acyl, optionally substituted acyloxyalkyl, optionally substituted alkyl, or optionally substituted alkoxy, wherein the combination of $R^{13b}$ and $R^{14b}$ can be taken together to form optionally substituted heterocyclyl;

each $R^{14a}$ and $R^{14b}$ is, independently, H, halo, hydroxy, thiol, optionally substituted acyl, optionally substituted amino acid, optionally substituted alkyl, optionally substituted haloalkyl, optionally substituted alkenyl, optionally substituted alkynyl, optionally substituted hydroxyalkyl (e.g., substituted with an O-protecting group), optionally substituted hydroxyalkenyl, optionally substituted alkoxy, optionally substituted alkenyloxy, optionally substituted alkynyloxy, optionally substituted aminoalkoxy, optionally substituted alkoxyalkoxy, optionally substituted acyloxyalkyl, optionally substituted amino (e.g., —NHR, wherein R is H, alkyl, aryl, phosphoryl, optionally substituted aminoalkyl, or optionally substituted carboxyaminoalkyl), azido, optionally substituted aryl, optionally substituted heterocyclyl, optionally substituted alkheterocyclyl, optionally substituted aminoalkyl, optionally substituted aminoalkenyl, or optionally substituted aminoalkynyl; and each of $R^{15}$ is, independently, H, optionally substituted alkyl, optionally substituted alkenyl, or optionally substituted alkynyl.

In particular embodiments, $R^{14b}$ is an optionally substituted amino acid (e.g., optionally substituted lysine). In some embodiments, $R^{14a}$ is H.

In some embodiments, B is a modified guanine Exemplary modified guanines include compounds of Formula (b15)-(b17):

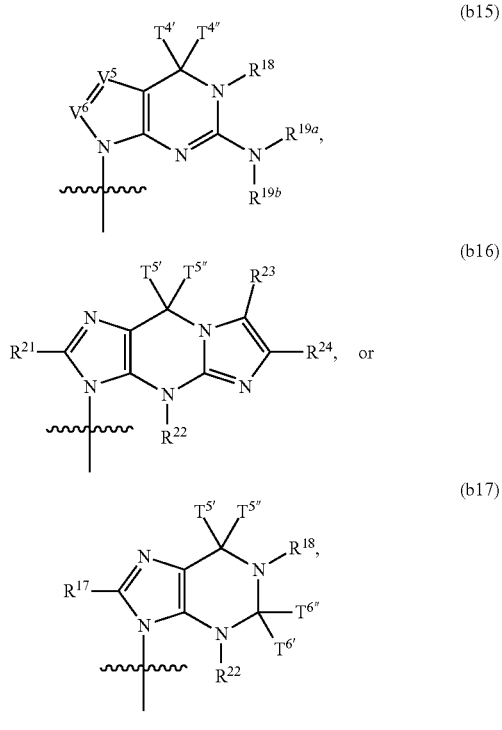

or a pharmaceutically acceptable salt or stereoisomer thereof, wherein each of $T^{4'}$, $T^{4''}$, $T^{5'}$, $T^{5''}$, $T^{6'}$, and $T^{6''}$ is, independently, H, optionally substituted alkyl, or optionally substituted alkoxy, and wherein the combination of $T^{4'}$ and $T^{4''}$ (e.g., as in $T^4$) or the combination of $T^{5'}$ and $T^{5''}$ (e.g., as in $T^5$) or the combination of $T^{6'}$ and $T^{6''}$ (e.g., as in $T^6$) join together form O (oxo), S (thio), or Se (seleno);

each of $V^5$ and $V^6$ is, independently, O, S, $N(R^{Vd})_{nv}$, or $C(R^{Vd})_{nv}$, wherein nv is an integer from 0 to 2 and each $R^{Vd}$ is, independently, H, halo, thiol, optionally substituted amino acid, cyano, amidine, optionally substituted aminoalkyl, optionally substituted aminoalkenyl, optionally substituted aminoalkynyl, optionally substituted alkyl, optionally substituted alkenyl, optionally substituted alkynyl, optionally substituted alkoxy, optionally substituted alkenyloxy, or optionally substituted alkynyloxy (e.g., optionally substituted with any substituent described herein, such as those selected from (1)-(21) for alkyl), optionally substituted thioalkoxy, or optionally substituted amino; and each of $R^{17}$, $R^{18}$, $R^{19a}$, $R^{19b}$, $R^{21}$, $R^{22}$, $R^{23}$, and $R^{24}$ is, independently, H, halo, thiol, optionally substituted alkyl, optionally substituted alkenyl, optionally substituted alkynyl, optionally substituted thioalkoxy, optionally substituted amino, or optionally substituted amino acid.

Exemplary modified guanosines include compounds of Formula (b37)-(b40):

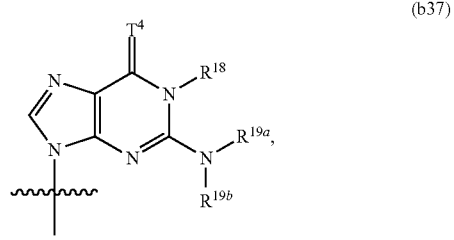

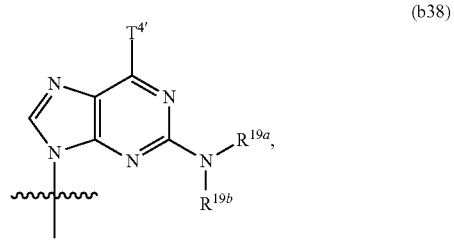

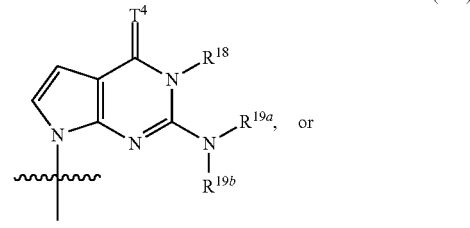

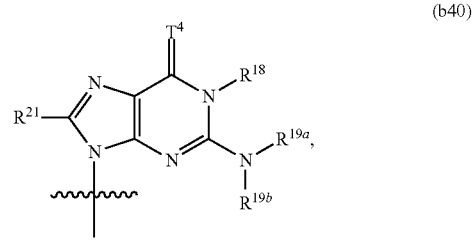

or a pharmaceutically acceptable salt or stereoisomer thereof, wherein each of $T^{4'}$ is, independently, H, optionally substituted alkyl, or optionally substituted alkoxy, and each $T^4$ is, independently, O (oxo), S (thio), or Se (seleno);

each of $R^{18}$, $R^{19a}$, $R^{19b}$, and $R^{21}$ is, independently, H, halo, thiol, optionally substituted alkyl, optionally substituted alkenyl, optionally substituted alkynyl, optionally substituted thioalkoxy, optionally substituted amino, or optionally substituted amino acid.

In some embodiments, $R^{18}$ is H or optionally substituted alkyl. In further embodiments, $T^4$ is oxo. In some embodiments, each of $R^{19a}$ and $R^{19b}$ is, independently, H or optionally substituted alkyl.

In some embodiments, B is a modified adenine. Exemplary modified adenines include compounds of Formula (b18)-(b20):

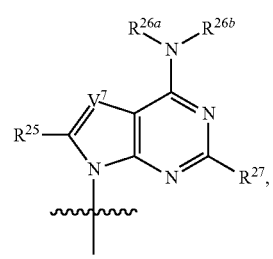
(b18)

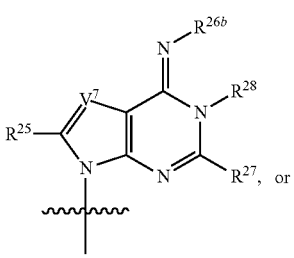
(b19)

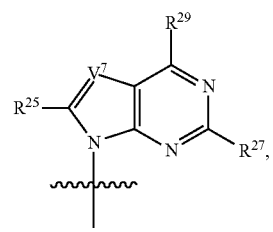
(b20)

or a pharmaceutically acceptable salt or stereoisomer thereof, wherein each $V^7$ is, independently, O, S, $N(R^{Ve})_{nv}$, or $C(R^{Ve})_{nv}$, wherein nv is an integer from 0 to 2 and each $R^{Ve}$ is, independently, H, halo, optionally substituted amino acid, optionally substituted alkyl, optionally substituted alkenyl, optionally substituted alkynyl, optionally substituted alkoxy, optionally substituted alkenyloxy, or optionally substituted alkynyloxy (e.g., optionally substituted with any substituent described herein, such as those selected from (1)-(21) for alkyl);

each $R^{25}$ is, independently, H, halo, thiol, optionally substituted alkyl, optionally substituted alkenyl, optionally substituted alkynyl, optionally substituted thioalkoxy, or optionally substituted amino;

each of $R^{26a}$ and $R^{26b}$ is, independently, H, optionally substituted acyl, optionally substituted amino acid, optionally substituted carbamoylalkyl, optionally substituted alkyl, optionally substituted alkenyl, optionally substituted alkynyl, optionally substituted hydroxyalkyl, optionally substituted hydroxyalkenyl, optionally substituted hydroxyalkynyl, optionally substituted alkoxy, or polyethylene glycol group (e.g., $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl); or an amino-polyethylene glycol group (e.g., $-NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl);

each $R^{27}$ is, independently, H, optionally substituted alkyl, optionally substituted alkenyl, optionally substituted alkynyl, optionally substituted alkoxy, optionally substituted thioalkoxy or optionally substituted amino;

each $R^{28}$ is, independently, H, optionally substituted alkyl, optionally substituted alkenyl, or optionally substituted alkynyl; and each $R^{29}$ is, independently, H, optionally substituted acyl, optionally substituted amino acid, optionally substituted carbamoylalkyl, optionally substituted alkyl, optionally substituted alkenyl, optionally substituted alkynyl, optionally substituted hydroxyalkyl, optionally substituted hydroxyalkenyl, optionally substituted alkoxy, or optionally substituted amino.

Exemplary modified adenines include compounds of Formula (b41)-(b43):

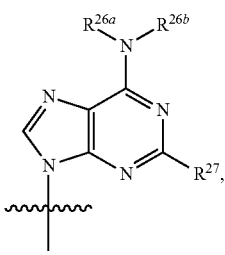
(b41)

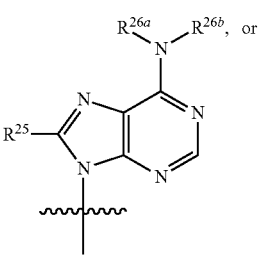
(b42)

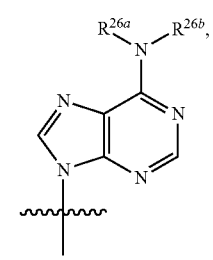
(b43)

or a pharmaceutically acceptable salt or stereoisomer thereof, wherein each $R^{25}$ is, independently, H, halo, thiol, optionally substituted alkyl, optionally substituted alkenyl, optionally substituted alkynyl, optionally substituted thioalkoxy, or optionally substituted amino;

each of $R^{26a}$ and $R^{26b}$ is, independently, H, optionally substituted acyl, optionally substituted amino acid, optionally substituted carbamoylalkyl, optionally substituted alkyl, optionally substituted alkenyl, optionally substituted alkynyl, optionally substituted hydroxyalkyl, optionally substituted hydroxyalkenyl, optionally substituted hydroxyalkynyl, optionally substituted alkoxy, or polyethylene glycol group (e.g., —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl); or an amino-polyethylene glycol group (e.g., —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl); and each $R^{27}$ is, independently, H, optionally substituted alkyl, optionally substituted alkenyl, optionally substituted alkynyl, optionally substituted alkoxy, optionally substituted thioalkoxy, or optionally substituted amino.

In some embodiments, $R^{26a}$ is H, and $R^{26b}$ is optionally substituted alkyl. In some embodiments, each of $R^{26a}$ and $R^{26b}$ is, independently, optionally substituted alkyl. In particular embodiments, $R^{27}$ is optionally substituted alkyl, optionally substituted alkoxy, or optionally substituted thioalkoxy. In other embodiments, $R^{25}$ is optionally substituted alkyl, optionally substituted alkoxy, or optionally substituted thioalkoxy.

In particular embodiments, the optional substituent for $R^{26a}$, $R^{26b}$, or $R^{29}$ is a polyethylene glycol group (e.g., —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl); or an amino-polyethylene glycol group (e.g., —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl).

In some embodiments, B may have Formula (b21):

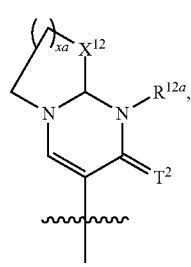

(b21)

wherein $X^{12}$ is, independently, O, S, optionally substituted alkylene (e.g., methylene), or optionally substituted heteroalkylene, xa is an integer from 0 to 3, and $R^{12a}$ and $T^2$ are as described herein.

In some embodiments, B may have Formula (b22):

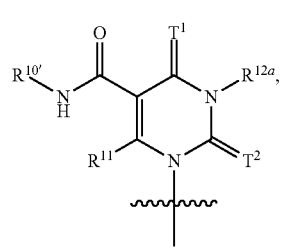

(b22)

wherein $R^{10'}$ is, independently, optionally substituted alkyl, optionally substituted alkenyl, optionally substituted alkynyl, optionally substituted aryl, optionally substituted heterocyclyl, optionally substituted aminoalkyl, optionally substituted aminoalkenyl, optionally substituted aminoalkynyl, optionally substituted alkoxy, optionally substituted alkoxycarbonylalkyl, optionally substituted alkoxycarbonylalkenyl, optionally substituted alkoxycarbonylalkynyl, optionally substituted alkoxycarbonylalkoxy, optionally substituted carboxyalkoxy, optionally substituted carboxyalkyl, or optionally substituted carbamoylalkyl, and $R^{11}$, $R^{12a}$, $T^1$ and $T^2$ are as described herein.

In some embodiments, B may have Formula (b23):

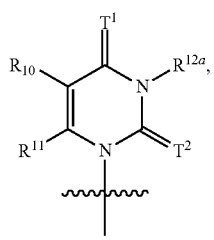

(b23)

wherein $R^{10}$ is optionally substituted heterocyclyl (e.g., optionally substituted furyl, optionally substituted thienyl, or optionally substituted pyrrolyl), optionally substituted aryl (e.g., optionally substituted phenyl or optionally substituted naphthyl), or any substituent described herein (e.g., for $R^{10}$); and wherein $R^{11}$ (e.g., H or any substituent described herein), $R^{12a}$ (e.g., H or any substituent described herein), $T^1$ (e.g., oxo or any substituent described herein), and $T^2$ (e.g., oxo or any substituent described herein) are as described herein.

In some embodiments, B may have Formula (b24):

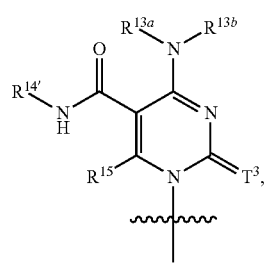

(b24)

wherein $R^{14'}$ is, independently, optionally substituted alkyl, optionally substituted alkenyl, optionally substituted alkynyl, optionally substituted aryl, optionally substituted heterocyclyl, optionally substituted alkaryl, optionally substituted alkheterocyclyl, optionally substituted aminoalkyl, optionally substituted aminoalkenyl, optionally substituted aminoalkynyl, optionally substituted alkoxy, optionally substituted alkoxycarbonylalkenyl, optionally substituted alkoxycarbonylalkynyl, optionally substituted alkoxycarbonylalkyl, optionally substituted alkoxycarbonylalkoxy, optionally substituted carboxyalkoxy, optionally substituted carboxyalkyl, or optionally substituted carbamoylalkyl, and $R^{13a}$, $R^{13b}$, $R^{15}$, and $T^3$ are as described herein.

In some embodiments, B may have Formula (b25):

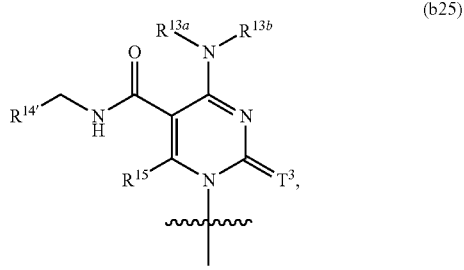

(b25)

wherein $R^{14'}$ is optionally substituted heterocyclyl (e.g., optionally substituted furyl, optionally substituted thienyl, or optionally substituted pyrrolyl), optionally substituted aryl (e.g., optionally substituted phenyl or optionally substituted naphthyl), or any substituent described herein (e.g., for $R^{14}$ or $R^{14'}$); and wherein $R^{13a}$ (e.g., H or any substituent described herein), $R^{13b}$ (e.g., H or any substituent described herein), $R^{15}$ (e.g., H or any substituent described herein), and $T^3$ (e.g., oxo or any substituent described herein) are as described herein.

In some embodiments, B is a nucleobase selected from the group consisting of cytosine, guanine, adenine, and uracil. In some embodiments, B may be:

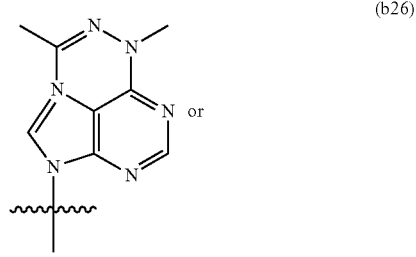

(b26)

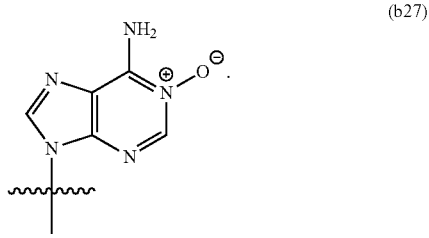

(b27)

In some embodiments, the modified nucleobase is a modified uracil. Exemplary nucleobases and nucleosides having a modified uracil include pseudouridine (ψ), pyridin-4-one ribonucleoside, 5-aza-uridine, 6-aza-uridine, 2-thio-5-aza-uridine, 2-thio-uridine ($s^2U$), 4-thio-uridine ($s^4U$), 4-thio-pseudouridine, 2-thio-pseudouridine, 5-hydroxy-uridine ($ho^5U$), 5-aminoallyl-uridine, 5-halo-uridine (e.g., 5-iodo-uridine or 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s^2U$), 5-aminomethyl-2-thio-uridine ($nm^5s^2U$), 5-methylaminomethyl-uridine ($mnm^5U$), 5-methylaminomethyl-2-thio-uridine ($mnm^5s^2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s^2U$), 5-propynyl-uridine, 1-propynyl-pseudouridine, 5-taurinomethyl-uridine ($τm^5U$), 1-taurinomethyl-pseudouridine, 5-taurinomethyl-2-thio-uridine($τm^5s^2U$), 1-taurinomethyl-4-thio-pseudouridine, 5-methyl-uridine ($m^5U$, i.e., having the nucleobase deoxythymine), 1-methylpseudouridine ($m^1ψ$), 5-methyl-2-thio-uridine ($m^5s^2U$), 1-methyl-4-thio-pseudouridine ($m^1s^4ψ$), 4-thio-1-methyl-pseudouridine, 3-methyl-pseudouridine ($m^3ψ$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine (also known as 1-methylpseudouridine ($m^1ψ$), 3-(3-amino-3-carboxypropyl)uridine ($acp^3U$), 1-methyl-3-(3-amino-3-carboxypropyl)pseudouridine ($acp^3ψ$), 5-(isopentenylaminomethyl)uridine ($inm^5U$), 5-(isopentenylaminomethyl)-2-thio-uridine ($inm^5s^2U$), α-thio-uridine, 2'-O-methyl-uridine (Um), 5,2'-O-dimethyl-uridine ($m^5Um$), 2'-O-methyl-pseudouridine (ψm), 2-thio-2'-O-methyl-uridine ($s^2Um$), 5-methoxycarbonylmethyl-2'-O-methyl-uridine ($mcm^5Um$), 5-carbamoylmethyl-2'-β-methyl-uridine ($ncm^5Um$), 5-carboxymethylaminomethyl-2'-O-methyl-uridine ($cmnm^5Um$), 3,2'-O-dimethyl-uridine ($m^3Um$), 5-(isopentenylaminomethyl)-2'-β-methyl-uridine ($inm^5Um$), 1-thio-uridine, deoxythymidine, 2'-F-ara-uridine, 2'-F-uridine, 2'-OH-ara-uridine, 5-(2-carbomethoxyvinyl) uridine, and 5-[3-(1-E-propenylamino)uridine.

In some embodiments, the modified nucleobase is a modified cytosine. Exemplary nucleobases and nucleosides having a modified cytosine include 5-aza-cytidine, 6-aza-cytidine, pseudoisocytidine, 3-methyl-cytidine ($m^3C$), N4-acetyl-cytidine ($ac^4C$), 5-formyl-cytidine ($f^5C$), N4-methyl-cytidine ($m^4C$), 5-methyl-cytidine ($m^5C$), 5-halo-cytidine (e.g., 5-iodo-cytidine), 5-hydroxymethyl-cytidine ($hm^5C$), 1-methyl-pseudoisocytidine, pyrrolo-cytidine, pyrrolo-pseudoisocytidine, 2-thio-cytidine ($s^2C$), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine ($k_2C$), α-thio-cytidine, 2'-O-methyl-cytidine (Cm), 5,2'-O-dimethyl-cytidine ($m^5Cm$), N4-acetyl-2'-O-methyl-cytidine ($ac^4Cm$), N4,2'-O-dimethyl-cytidine ($m^4Cm$), 5-formyl-2'-O-methyl-cytidine ($f^5Cm$), N4,N4,2'-O-trimethyl-cytidine ($m^4_2Cm$), 1-thio-cytidine, 2'-F-ara-cytidine, 2'-F-cytidine, and 2'-OH-ara-cytidine.

In some embodiments, the modified nucleobase is a modified adenine. Exemplary nucleobases and nucleosides having a modified adenine include 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m$^1$A), 2-methyl-adenine (m$^2$A), N6-methyl-adenosine (m$^6$A), 2-methylthio-N6-methyl-adenosine (ms$^2$m$^6$A), N6-isopentenyl-adenosine (i$^6$A), 2-methylthio-N6-isopentenyl-adenosine (ms$^2$i$^6$A), N6-(cis-hydroxyisopentenyl)adenosine (io$^6$A), 2-methylthio-N6-(cis-hydroxyisopentenyl)adenosine (ms$^2$io$^6$A), N6-glycinylcarbamoyl-adenosine (g$^6$A), N6-threonylcarbamoyl-adenosine (t$^6$A), N6-methyl-N6-threonylcarbamoyl-adenosine (m$^6$t$^6$A), 2-methylthio-N6-threonylcarbamoyl-adenosine (ms$^2$g$^6$A), N6,N6-dimethyl-adenosine (m$^6_2$A), N6-hydroxynorvalylcarbamoyl-adenosine (hn$^6$A), 2-methylthio-N6-hydroxynorvalylcarbamoyl-adenosine (ms$^2$hn$^6$A), N6-acetyl-adenosine (ac$^6$A), 7-methyl-adenine, 2-methylthio-adenine, 2-methoxy-adenine, α-thio-adenosine, 2'-O-methyl-adenosine (Am), N6,2'-O-dimethyl-adenosine (m$^6$Am), N6,N6,2'-O-trimethyl-adenosine (m$^6_2$Am), 1,2'-O-dimethyl-adenosine (m$^1$Am), 2'-β-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-aminopentaoxanonadecyl)-adenosine.

In some embodiments, the modified nucleobase is a modified guanine Exemplary nucleobases and nucleosides having a modified guanine include inosine (I), 1-methyl-inosine (m$^1$I), wyosine (imG), methylwyosine (mimG), 4-demethylwyosine (imG-14), isowyosine (imG2), wybutosine (yW), peroxywybutosine (o$_2$yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ$_0$), 7-aminomethyl-7-deaza-guanosine (preQ$_1$), archaeosine (G$^+$), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m$^1$G), N2-methyl-guanosine (m$^2$G), N2,N2-dimethyl-guanosine (m$^2_2$G), N2,7-dimethyl-guanosine (m$^{2,7}$G), N2, N2,7-dimethyl-guanosine (m$^{2,2,7}$G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m$^2$Gm), N2,N2-dimethyl-2'-O-methyl-guanosine (m$^2_2$Gm), 1-methyl-2'-O-methyl-guanosine (m$^1$Gm), N2,7-dimethyl-2'-O-methyl-guanosine (m$^{2,7}$Gm), 2'-O-methyl-inosine (Im), 1,2'-O-dimethyl-inosine (m$^1$Im), and 2'-O-ribosylguanosine (phosphate) (Gr(p)).

The nucleobase of the nucleotide can be independently selected from a purine, a pyrimidine, a purine or pyrimidine analog. For example, the nucleobase can each be independently selected from adenine, cytosine, guanine, uracil, or hypoxanthine. In another embodiment, the nucleobase can also include, for example, naturally-occurring and synthetic derivatives of a base, including pyrazolo[3,4-d]pyrimidines, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-propynyl uracil and cytosine, 6-azo uracil, cytosine and thymine, 5-uracil (pseudouracil), 4-thiouracil, 8-halo (e.g., 8-bromo), 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, deazaguanine, 7-deazaguanine, 3-deazaguanine, deazaadenine, 7-deazaadenine, 3-deazaadenine, pyrazolo[3,4-d]pyrimidine, imidazo[1,5-a]1,3,5 triazinones, 9-deazapurines, imidazo[4,5-d]pyrazines, thiazolo[4,5-d]pyrimidines, pyrazin-2-ones, 1,2,4-triazine, pyridazine; and 1,3,5 triazine. When the nucleotides are depicted using the shorthand A, G, C, T or U, each letter refers to the representative base and/or derivatives thereof, e.g., A includes adenine or adenine analogs, e.g., 7-deaza adenine).

Modifications on the Internucleoside Linkage

The modified nucleotides, which may be incorporated into a polynucleotide, primary construct, or mmRNA molecule, can be modified on the internucleoside linkage (e.g., phosphate backbone). Herein, in the context of the polynucleotide backbone, the phrases "phosphate" and "phosphodiester" are used interchangeably. Backbone phosphate groups can be modified by replacing one or more of the oxygen atoms with a different substituent. Further, the modified nucleosides and nucleotides can include the wholesale replacement of an unmodified phosphate moiety with another internucleoside linkage as described herein. Examples of modified phosphate groups include, but are not limited to, phosphorothioate, phosphoroselenates, boranophosphates, boranophosphate esters, hydrogen phosphonates, phosphoramidates, phosphorodiamidates, alkyl or aryl phosphonates, and phosphotriesters. Phosphorodithioates have both non-linking oxygens replaced by sulfur. The phosphate linker can also be modified by the replacement of a linking oxygen with nitrogen (bridged phosphoramidates), sulfur (bridged phosphorothioates), and carbon (bridged methylene-phosphonates).

The α-thio substituted phosphate moiety is provided to confer stability to RNA and DNA polymers through the unnatural phosphorothioate backbone linkages. Phosphorothioate DNA and RNA have increased nuclease resistance and subsequently a longer half-life in a cellular environment. Phosphorothioate linked oncology-related polynucleotides, primary constructs, or mmRNA molecules are expected to also reduce the innate immune response through weaker binding/activation of cellular innate immune molecules.

In specific embodiments, a modified nucleoside includes an alpha-thio-nucleoside (e.g., 5'-O-(1-thiophosphate)-adenosine, 5'-O-(1-thiophosphate)-cytidine (α-thio-cytidine), 5'-O-(1-thiophosphate)-guanosine, 5'-O-(1-thiophosphate)-uridine, or 5'-O-(1-thiophosphate)-pseudouridine).

Other internucleoside linkages that may be employed according to the present invention, including internucleoside linkages which do not contain a phosphorous atom, are described herein below.

Combinations of Modified Sugars, Nucleobases, and Internucleoside Linkages

The oncology-related polynucleotides, primary constructs, and mmRNA of the invention can include a combination of modifications to the sugar, the nucleobase, and/or the internucleoside linkage. These combinations can include any one or more modifications described herein. For examples, any of the nucleotides described herein in Formulas (Ia), (Ia-1)-(Ia-3), (Ib)-(If), (IIa)-(IIp), (IIb-1), (IIb-2), (IIc-1)-(IIc-2), (IIn-1), (IIn-2), (IVa)-(IVl), and (IXa)-(IXr) can be combined with any of the nucleobases described herein (e.g., in Formulas (b1)-(b43) or any other described herein).

Synthesis of Oncology-Related Polypeptides, Primary Constructs, and mmRNA Molecules The oncology-related polypeptides, oncology-related primary constructs, and oncology-related mmRNA molecules for use in accordance with the invention may be prepared according to any useful technique, as described herein. The modified nucleosides and nucleotides used in the synthesis of oncology-related polynucleotides, oncology-related primary constructs, and oncology-related mmRNA molecules disclosed herein can be prepared from readily available starting materials using the following general methods and procedures. Where typical or preferred process conditions (e.g., reaction temperatures, times, mole ratios of reactants, solvents, pressures, etc.) are provided, a skilled artisan would be able to optimize and develop additional process conditions. Optimum reaction conditions may vary with the particular reactants or solvent used, but such conditions can be determined by one skilled in the art by routine optimization procedures.

The processes described herein can be monitored according to any suitable method known in the art. For example, product formation can be monitored by spectroscopic means, such as nuclear magnetic resonance spectroscopy (e.g., $^1$H or $^{13}$C) infrared spectroscopy, spectrophotometry (e.g., UV-visible), or mass spectrometry, or by chromatography such as high performance liquid chromatography (HPLC) or thin layer chromatography.

Preparation of oncology-related polypeptides, oncology-related primary constructs, and oncology-related mmRNA molecules of the present invention can involve the protection and deprotection of various chemical groups. The need for protection and deprotection, and the selection of appropriate protecting groups can be readily determined by one skilled in the art. The chemistry of protecting groups can be found, for example, in Greene, et al., *Protective Groups in Organic Synthesis*, 2d. Ed., Wiley & Sons, 1991, which is incorporated herein by reference in its entirety.

The reactions of the processes described herein can be carried out in suitable solvents, which can be readily selected by one of skill in the art of organic synthesis. Suitable solvents can be substantially nonreactive with the starting materials (reactants), the intermediates, or products at the temperatures at which the reactions are carried out, i.e., temperatures which can range from the solvent's freezing temperature to the solvent's boiling temperature. A given reaction can be carried out in one solvent or a mixture of more than one solvent. Depending on the particular reaction step, suitable solvents for a particular reaction step can be selected.

Resolution of racemic mixtures of modified nucleosides and nucleotides (e.g., mmRNA molecules) can be carried out by any of numerous methods known in the art. An example method includes fractional recrystallization using a "chiral resolving acid" which is an optically active, salt-forming organic acid. Suitable resolving agents for fractional recrystallization methods are, for example, optically active acids, such as the D and L forms of tartaric acid, diacetyltartaric acid, dibenzoyltartaric acid, mandelic acid, malic acid, lactic acid or the various optically active camphorsulfonic acids. Resolution of racemic mixtures can also be carried out by elution on a column packed with an optically active resolving agent (e.g., dinitrobenzoylphenylglycine). Suitable elution solvent composition can be determined by one skilled in the art.

Modified nucleosides and nucleotides (e.g., building block molecules) can be prepared according to the synthetic methods described in Ogata et al., J. Org. Chem. 74:2585-2588 (2009); Purmal et al., Nucl. Acids Res. 22(1): 72-78, (1994); Fukuhara et al., Biochemistry, 1(4): 563-568 (1962); and Xu et al., Tetrahedron, 48(9): 1729-1740 (1992), each of which are incorporated by reference in their entirety.

The oncology-related polypeptides, oncology-related primary constructs, and oncology-related mmRNA of the invention may or may not be uniformly modified along the entire length of the molecule. For example, one or more or all types of nucleotide (e.g., purine or pyrimidine, or any one or more or all of A, G, U, C) may or may not be uniformly modified in an oncology-related polynucleotide of the invention, or in a given predetermined sequence region thereof (e.g. one or more of the sequence regions represented in FIG. 1). In some embodiments, all nucleotides X in an oncology-related polynucleotide of the invention (or in a given sequence region thereof) are modified, wherein X may any one of nucleotides A, G, U, C, or any one of the combinations A+G, A+U, A+C, G+U, G+C, U+C, A+G+U, A+G+C, G+U+C or A+G+C.

Different sugar modifications, nucleotide modifications, and/or internucleoside linkages (e.g., backbone structures) may exist at various positions in the oncology-related polynucleotide, oncology-related primary construct, or oncology-related mmRNA. One of ordinary skill in the art will appreciate that the nucleotide analogs or other modification(s) may be located at any position(s) of an oncology-related polynucleotide, oncology-related primary construct, or oncology-related mmRNA such that the function of the oncology-related polynucleotide, oncology-related primary construct, or oncology-related mmRNA is not substantially decreased. A modification may also be a 5' or 3' terminal modification. The oncology-related polynucleotide, oncology-related primary construct, or oncology-related mmRNA may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, the oncology-related polynucleotide, oncology-related primary construct, or oncology-related mmRNA includes a modified pyrimidine (e.g., a modified uracil/uridine/U or modified cytosine/cytidine/C). In some embodiments, the uracil or uridine (generally: U) in the oncology-related polynucleotide, oncology-related primary construct, or oncology-related mmRNA molecule may be replaced with from about 1% to about 100% of a modified uracil or modified uridine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified uracil or modified uridine). The modified uracil or uridine can be replaced by a compound having a single unique structure or by a plurality of compounds having different structures (e.g., 2, 3, 4 or more unique structures, as described herein). In some embodiments, the cytosine or cytidine (generally: C) in the oncology-related polynucleotide, oncology-related primary construct, or oncology-related mmRNA molecule may be replaced with from about 1% to about 100% of a modified cytosine or modified cytidine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified cytosine or modified cytidine). The modified cytosine or cytidine can be replaced by a compound having a single unique structure or by a plurality of compounds having different structures (e.g., 2, 3, 4 or more unique structures, as described herein).

In some embodiments, the present disclosure provides methods of synthesizing an oncology-related polynucleotide, oncology-related primary construct, or oncology-related mmRNA (e.g., the first region, first flanking region, or second flanking region) including n number of linked nucleosides having Formula (Ia-1):

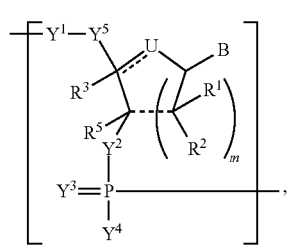

(Ia-1)

comprising:
a) reacting a nucleotide of Formula (IV-1):

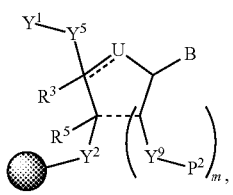

(IV-1)

with a phosphoramidite compound of Formula (V-1):

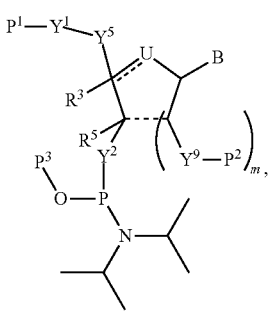

(V-1)

wherein $Y^9$ is H, hydroxy, phosphoryl, pyrophosphate, sulfate, amino, thiol, optionally substituted amino acid, or a peptide (e.g., including from 2 to 12 amino acids); and each $P^1$, $P^2$, and $P^3$ is, independently, a suitable protecting group; and ⬤ denotes a solid support;

to provide an oncology-related polynucleotide, oncology-related primary construct, or oncology-related mmRNA of Formula (VI-1):

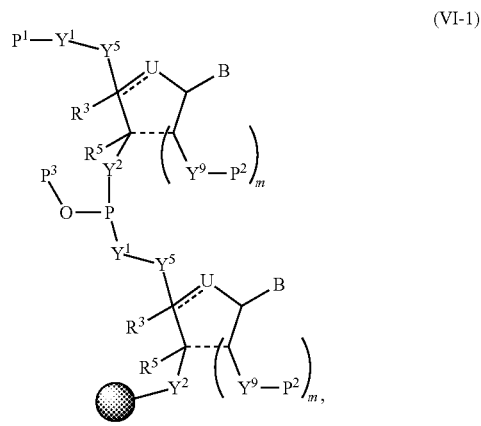

(VI-1)

and
b) oxidizing or sulfurizing the oncology-related polynucleotide, oncology-related primary construct, or oncology-related mmRNA of Formula (V) to yield an oncology-related polynucleotide, oncology-related primary construct, or oncology-related mmRNA of Formula (VII-1):

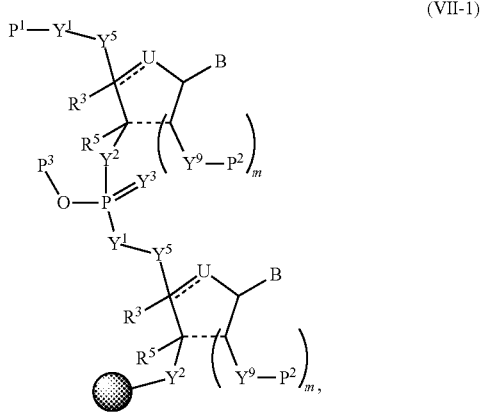

(VII-1)

and
c) removing the protecting groups to yield the oncology-related polynucleotide, oncology-related primary construct, or oncology-related mmRNA of Formula (Ia).

In some embodiments, steps a) and b) are repeated from 1 to about 10,000 times. In some embodiments, the methods further comprise a nucleotide (e.g., mmRNA molecule) selected from the group consisting of A, C, G and U adenosine, cytosine, guanosine, and uracil. In some embodiments, the nucleobase may be a pyrimidine or derivative thereof. In some embodiments, the oncology-related polynucleotide, oncology-related primary construct, or oncology-related mmRNA is translatable.

Other components of oncology-related polynucleotides, oncology-related primary constructs, and oncology-related mmRNA are optional, and are beneficial in some embodiments. For example, a 5' untranslated region (UTR) and/or a 3'UTR are provided, wherein either or both may independently contain one or more different nucleotide modifications. In such embodiments, nucleotide modifications may also be present in the translatable region. Also provided are oncology-related polynucleotides, oncology-related primary constructs, and oncology-related mmRNA containing a Kozak sequence.

Exemplary syntheses of modified nucleotides, which are incorporated into an oncology-related modified nucleic acid or mmRNA, e.g., RNA or mRNA, are provided below in Scheme 1 through Scheme 11. Scheme 1 provides a general method for phosphorylation of nucleosides, including modified nucleosides.

Scheme 1

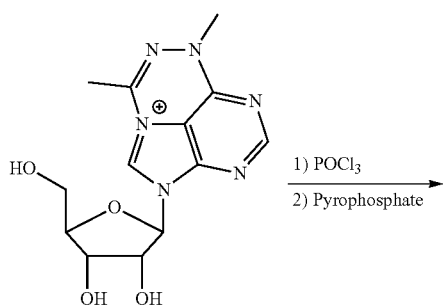

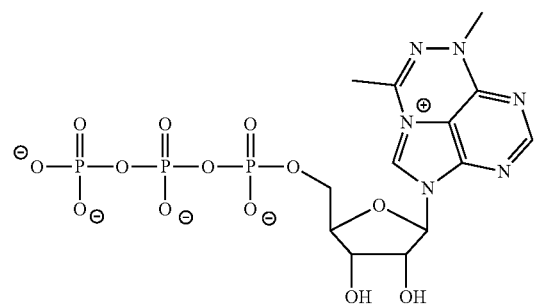

Various protecting groups may be used to control the reaction. For example, Scheme 2 provides the use of multiple protecting and deprotecting steps to promote phosphorylation at the 5' position of the sugar, rather than the 2' and 3' hydroxyl groups.

Scheme 2

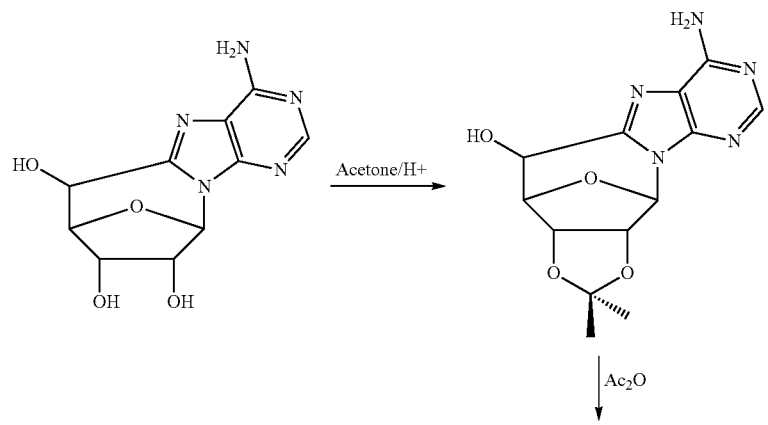

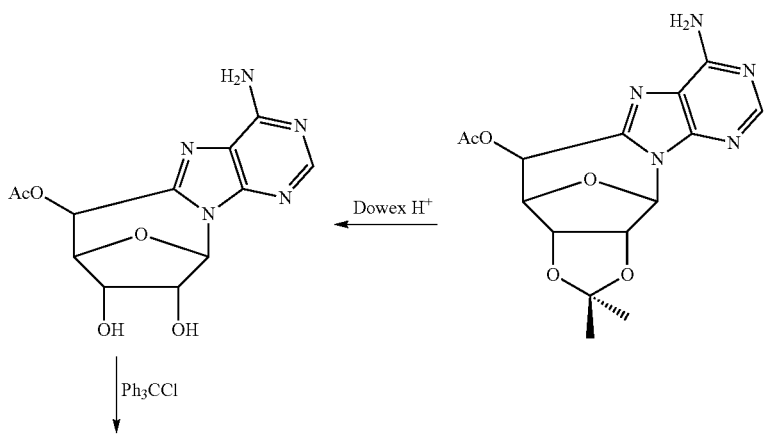

181

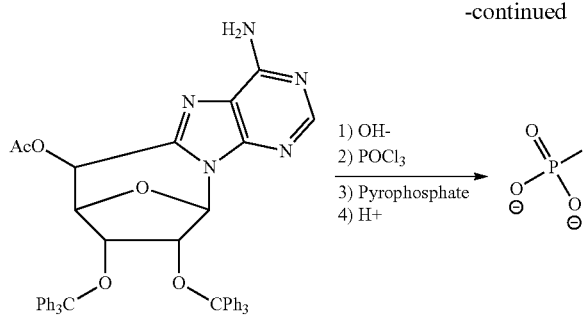

1) OH-
2) POCl₃
3) Pyrophosphate
4) H+

182

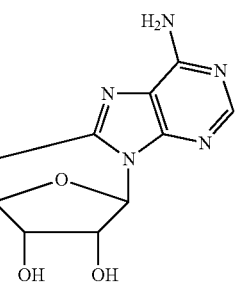

Modified nucleotides can be synthesized in any useful manner. Schemes 3, 4, and 7 provide exemplary methods for synthesizing modified nucleotides having a modified purine nucleobase; and Schemes 5 and 6 provide exemplary methods for synthesizing modified nucleotides having a modified pseudouridine or pseudoisocytidine, respectively.

Scheme 3

Scheme 4

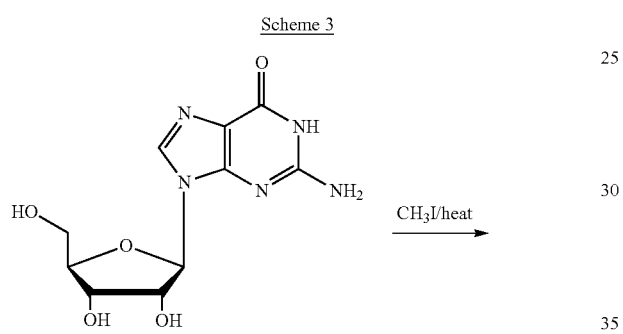

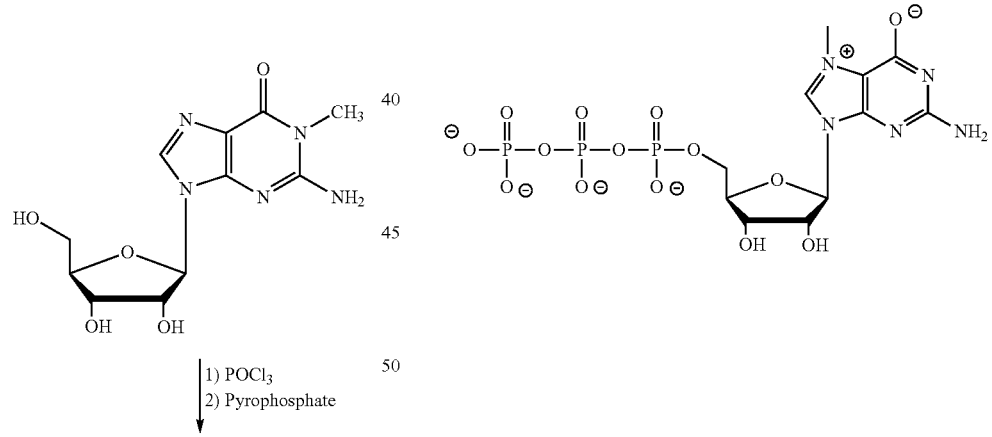

Scheme 5

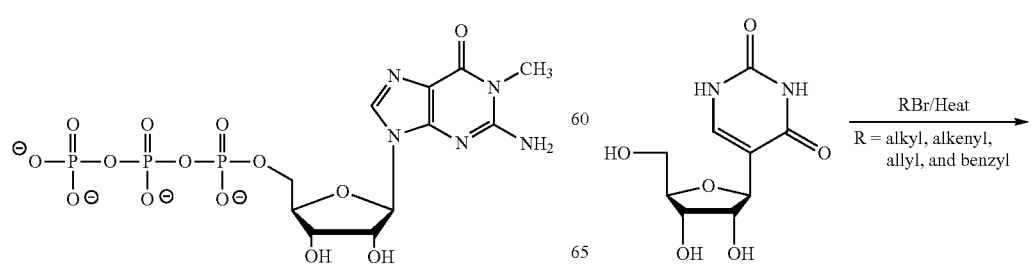

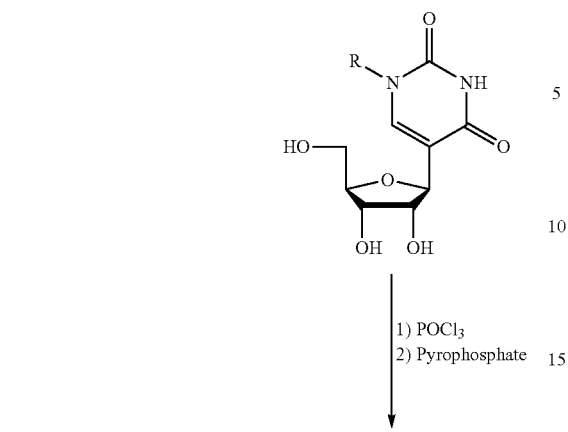
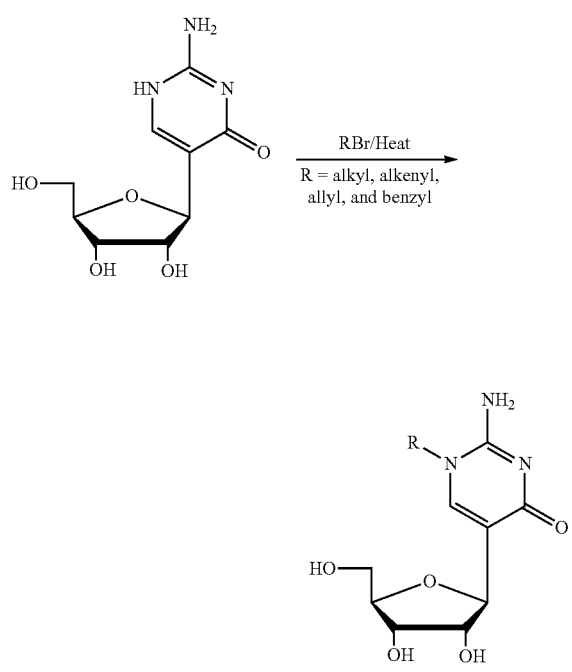
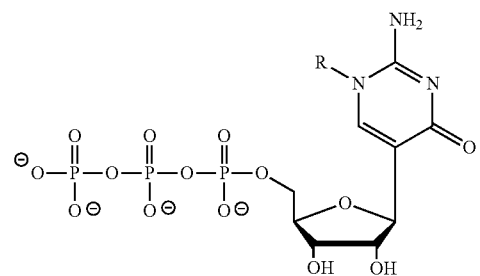
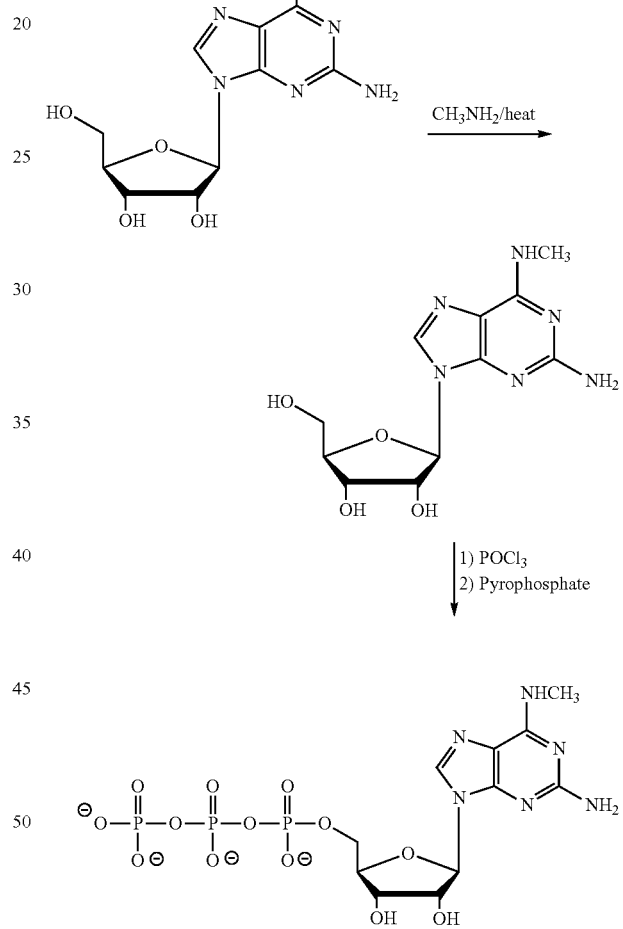
Schemes 8 and 9 provide exemplary syntheses of modified nucleotides. Scheme 10 provides a non-limiting biocatalytic method for producing nucleotides.
Scheme 8

185
-continued
186
-continued
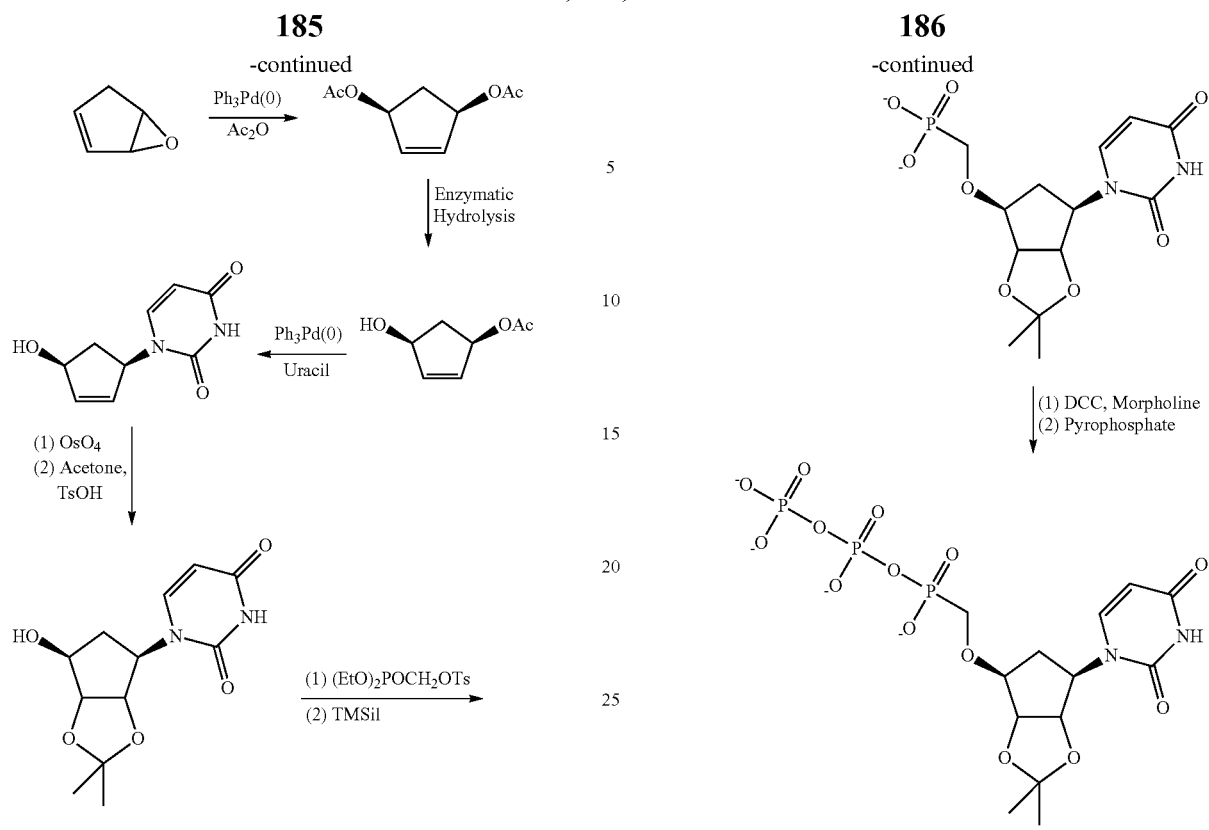
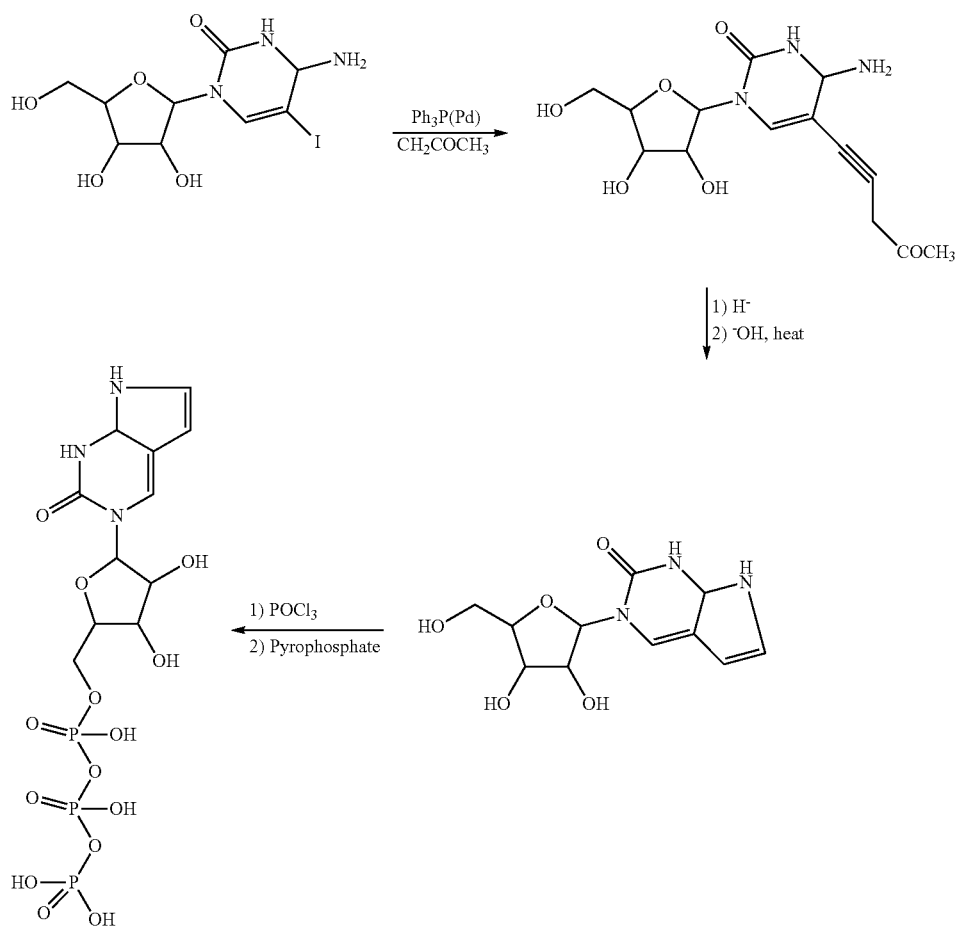
Scheme 9

Scheme 10

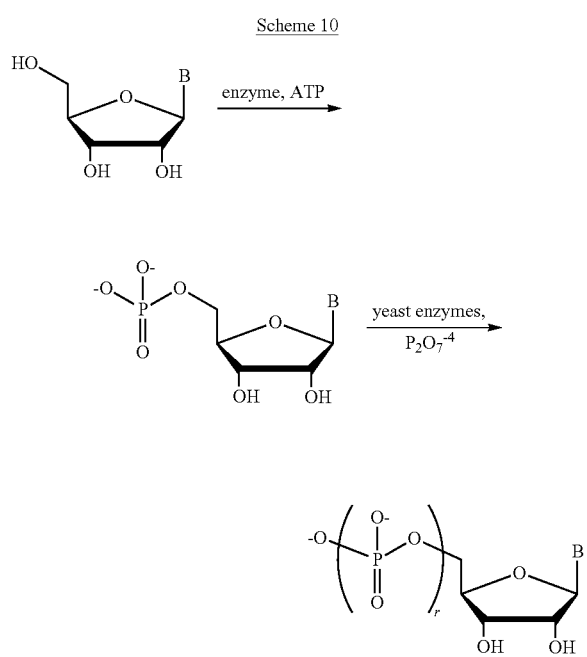

Scheme 11 provides an exemplary synthesis of a modified uracil, where the N1 position is modified with R12b, as provided elsewhere, and the 5'-position of ribose is phosphorylated. T1, T2, R12a, R12b, and r are as provided herein. This synthesis, as well as optimized versions thereof, can be used to modify other pyrimidine nucleobases and purine nucleobases (see e.g., Formulas (b1)-(b43)) and/or to install one or more phosphate groups (e.g., at the 5' position of the sugar). This alkylating reaction can also be used to include one or more optionally substituted alkyl group at any reactive group (e.g., amino group) in any nucleobase described herein (e.g., the amino groups in the Watson-Crick base-pairing face for cytosine, uracil, adenine, and guanine)

Scheme 11

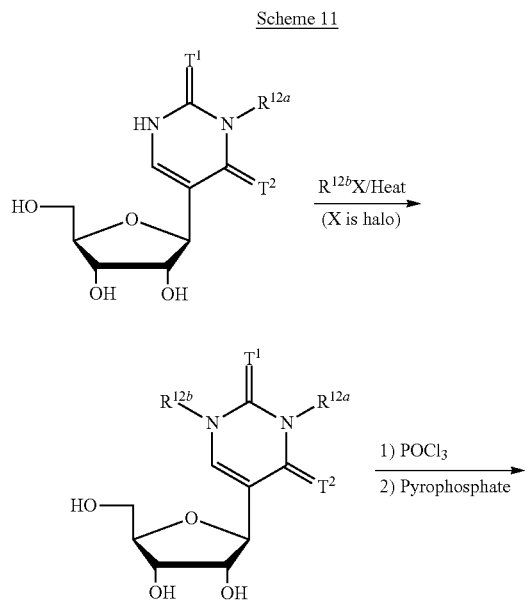

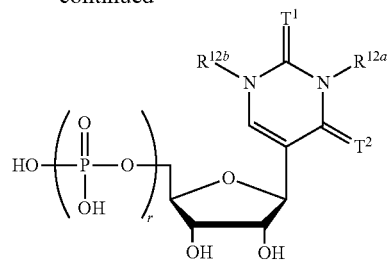

Combinations of Nucleotides in mmRNA

Further examples of modified nucleotides and modified nucleotide combinations are provided below in Table 10. These combinations of modified nucleotides can be used to form the oncology-related polypeptides, oncology-related primary constructs, or oncology-related mmRNA of the invention.

Unless otherwise noted, the modified nucleotides may be completely substituted for the natural nucleotides of the modified nucleic acids or mmRNA of the invention. As a non-limiting example, the natural nucleotide uridine may be substituted with a modified nucleoside described herein. In another non-limiting example, the natural nucleotide uridine may be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein.

TABLE 10

| Modified Nucleotide | Modified Nucleotide Combination |
|---|---|
| α-thio-cytidine | α-thio-cytidine/5-iodo-uridine |
| | α-thio-cytidine/N1-methyl-pseudouridine |
| | α-thio-cytidine/α-thio-uridine |
| | α-thio-cytidine/5-methyl-uridine |
| | α-thio-cytidine/pseudouridine |
| | about 50% of the cytosines are α-thio-cytidine |
| pseudoisocytidine | pseudoisocytidine/5-iodo-uridine |
| | pseudoisocytidine/N1-methyl-pseudouridine |
| | pseudoisocytidine/α-thio-uridine |
| | pseudoisocytidine/5-methyl-uridine |
| | pseudoisocytidine/pseudouridine |
| | about 25% of cytosines are pseudoisocytidine |
| | pseudoisocytidine/about 50% of uridines are N1-methyl-pseudouridine and about 50% of uridines are pseudouridine |
| | pseudoisocytidine/about 25% of uridines are N1-methyl-pseudouridine and about 25% of uridines are pseudouridine |
| pyrrolo-cytidine | pyrrolo-cytidine/5-iodo-uridine |
| | pyrrolo-cytidine/N1-methyl-pseudouridine |
| | pyrrolo-cytidine/α-thio-uridine |
| | pyrrolo-cytidine/5-methyl-uridine |
| | pyrrolo-cytidine/pseudouridine |
| | about 50% of the cytosines are pyrrolo-cytidine |
| 5-methyl-cytidine | 5-methyl-cytidine/5-iodo-uridine |
| | 5-methyl-cytidine/N1-methyl-pseudouridine |
| | 5-methyl-cytidine/α-thio-uridine |
| | 5-methyl-cytidine/5-methyl-uridine |
| | 5-methyl-cytidine/pseudouridine |
| | about 25% of cytosines are 5-methyl-cytidine |
| | about 50% of cytosines are 5-methyl-cytidine |
| | 5-methyl-cytidine/5-methoxy-uridine |
| | 5-methyl-cytidine/5-bromo-uridine |
| | 5-methyl-cytidine/2-thio-uridine |
| | 5-methyl-cytidine/about 50% of uridines are 2-thio-uridine |
| | about 50% of uridines are 5-methyl-cytidine/about 50% of uridines are 2-thio-uridine |

TABLE 10-continued

| Modified Nucleotide | Modified Nucleotide Combination |
|---|---|
| N4-acetyl-cytidine | N4-acetyl-cytidine/5-iodo-uridine |
| | N4-acetyl-cytidine/N1-methyl-pseudouridine |
| | N4-acetyl-cytidine/α-thio-uridine |
| | N4-acetyl-cytidine/5-methyl-uridine |
| | N4-acetyl-cytidine/pseudouridine |
| | about 50% of cytosines are N4-acetyl-cytidine |
| | about 25% of cytosines are N4-acetyl-cytidine |
| | N4-acetyl-cytidine/5-methoxy-uridine |
| | N4-acetyl-cytidine/5-bromo-uridine |
| | N4-acetyl-cytidine/2-thio-uridine |
| | about 50% of cytosines are N4-acetyl-cytidine/about 50% of uridines are 2-thio-uridine |

Further examples of modified nucleotide combinations are provided below in Table 11. These combinations of modified nucleotides can be used to form the polypeptides, primary constructs, or mmRNA of the invention.

TABLE 11

| Modified Nucleotide | Modified Nucleotide Combination |
|---|---|
| modified cytidine having one or more nucleobases of Formula (b10) | modified cytidine with (b10)/pseudouridine |
| | modified cytidine with (b10)/N1-methyl-pseudouridine |
| | modified cytidine with (b10)/5-methoxy-uridine |
| | modified cytidine with (b10)/5-methyl-uridine |
| | modified cytidine with (b10)/5-bromo-uridine |
| | modified cytidine with (b10)/2-thio-uridine |
| | about 50% of cytidine substituted with modified cytidine (b10)/about 50% of uridines are 2-thio-uridine |
| modified cytidine having one or more nucleobases of Formula (b32) | modified cytidine with (b32)/pseudouridine |
| | modified cytidine with (b32)/N1-methyl-pseudouridine |
| | modified cytidine with (b32)/5-methoxy-uridine |
| | modified cytidine with (b32)/5-methyl-uridine |
| | modified cytidine with (b32)/5-bromo-uridine |
| | modified cytidine with (b32)/2-thio-uridine |
| | about 50% of cytidine substituted with modified cytidine (b32)/about 50% of uridines are 2-thio-uridine |
| modified uridine having one or more nucleobases of Formula (b1) | modified uridine with (b1)/N4-acetyl-cytidine |
| | modified uridine with (b1)/5-methyl-cytidine |
| modified uridine having one or more nucleobases of Formula (b8) | modified uridine with (b8)/N4-acetyl-cytidine |
| | modified uridine with (b8)/5-methyl-cytidine |
| modified uridine having one or more nucleobases of Formula (b28) | modified uridine with (b28)/N4-acetyl-cytidine |
| | modified uridine with (b28)/5-methyl-cytidine |
| modified uridine having one or more nucleobases of Formula (b29) | modified uridine with (b29)/N4-acetyl-cytidine |
| | modified uridine with (b29)/5-methyl-cytidine |
| modified uridine having one or more nucleobases of Formula (b30) | modified uridine with (b30)/N4-acetyl-cytidine |
| | modified uridine with (b30)/5-methyl-cytidine |

In some embodiments, at least 25% of the cytosines are replaced by a compound of Formula (b10)-(b14) (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

In some embodiments, at least 25% of the uracils are replaced by a compound of Formula (b1)-(b9) (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

In some embodiments, at least 25% of the cytosines are replaced by a compound of Formula (b10)-(b14), and at least 25% of the uracils are replaced by a compound of Formula (b1)-(b9) (e.g., at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%).

IV. PHARMACEUTICAL COMPOSITIONS

Formulation, Administration, Delivery and Dosing

The present invention provides oncology-related polynucleotides, oncology-related primary constructs and oncology-related mmRNA compositions and complexes in combination with one or more pharmaceutically acceptable excipients. Pharmaceutical compositions may optionally comprise one or more additional active substances, e.g. therapeutically and/or prophylactically active substances. General considerations in the formulation and/or manufacture of pharmaceutical agents may be found, for example, in *Remington: The Science and Practice of Pharmacy* 21$^{st}$ ed., Lippincott Williams & Wilkins, 2005 (incorporated herein by reference).

In some embodiments, compositions are administered to humans, human patients or subjects. For the purposes of the present disclosure, the phrase "active ingredient" generally refers to oncology-related polynucleotides, oncology-related primary constructs and oncology-related mmRNA to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

A pharmaceutical composition in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Formulations

The oncology-related polynucleotide, oncology-related primary construct, and oncology-related mmRNA of the invention can be formulated using one or more excipients to: (1) increase stability; (2) increase cell transfection; (3) permit the sustained or delayed release (e.g., from a depot formulation of the oncology-related polynucleotide, oncology-related primary construct, or mmRNA); (4) alter the biodistribution (e.g., target the oncology-related polynucleotide, oncology-related primary construct, or oncology-related mmRNA to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with oncology-related polynucleotide, primary oncology-related construct, or oncology-related mmRNA (e.g., for transplantation into a subject), hyaluronidase, nanoparticle mimics and combinations thereof. Further, the oncology-related polynucleotide, oncology-related primary construct, or oncology-related mmRNA of the present invention may be formulated using self-assembled nucleic acid nanoparticles.

Accordingly, the formulations of the invention can include one or more excipients, each in an amount that together increases the stability of the oncology-related polynucleotide, oncology-related primary construct, or oncology-related mmRNA, increases cell transfection by the oncology-related polynucleotide, oncology-related primary construct, or oncology-related mmRNA, increases the expression of oncology-related polynucleotide, oncology-related primary construct, or oncology-related mmRNA encoded protein, and/or alters the release profile of oncology-related polynucleotide, oncology-related primary construct, or oncology-related mmRNA encoded proteins. Further, the oncology-related primary construct and oncology-related mmRNA of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient may generally be equal to the dosage of the active ingredient which would be administered to a subject and/or a convenient fraction of such a dosage including, but not limited to, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient.

In some embodiments, the formulations described herein may contain at least one oncology-related mmRNA. As a non-limiting example, the formulations may contain 1, 2, 3, 4 or 5 oncology-related mmRNA. In one embodiment the formulation may contain modified mRNA encoding proteins selected from categories such as, oncology-related proteins. In one embodiment, the formulation contains at least three oncology-related modified mRNA encoding oncology-related proteins. In one embodiment, the formulation contains at least five oncology-related modified mRNA encoding oncology-related proteins.

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, the particle size of the lipid nanoparticle may be increased and/or decreased. The change in particle size may be able to help counter biological reaction such as, but not limited to, inflammation or may increase the biological effect of the oncology-related modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients may optionally be included in the pharmaceutical formulations of the invention.

Lipidoids

The synthesis of lipidoids has been extensively described and formulations containing these compounds are particularly suited for delivery of oncology-related polynucleotides, primary constructs or mmRNA (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010; all of which is incorporated herein in their entirety), the present disclosure describes their formulation and use in delivering single stranded oncology-related polynucleotides, primary constructs, or mmRNA. Complexes, micelles, liposomes or particles can be prepared containing these lipidoids and therefore, can result in an effective delivery of the oncology-related polynucleotide, primary construct, or mmRNA, as judged by the production of an encoded protein, following the injection of a lipidoid formulation via localized and/or systemic routes of administration. Lipidoid complexes of oncology-related polynucleotides, primary constructs, or mmRNA can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, oligonucleotide to lipid ratio, and biophysical parameters such as, but not limited to, particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010); herein incorporated by reference in its entirety), C12-200 (including derivatives and variants), and MD1, can be tested for in vivo activity.

Figure 2:
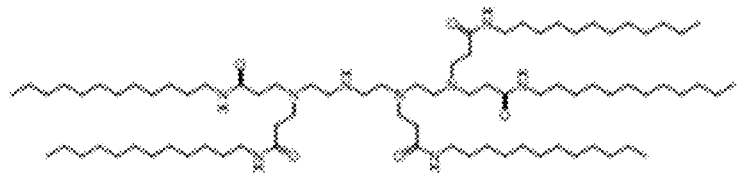
FIG. 2 illustrates lipid structures in the prior art useful in the present invention. Shown are the structures for 98N12-5 (TETA5-LAP), DLin-DMA, DLin-K-DMA (2,2-Dilinoleyl-4-dimethylaminomethyl-[1,3]-dioxolane), DLin-KC2-DMA, DLin-MC3-DMA and C12-200.
Figure 2:
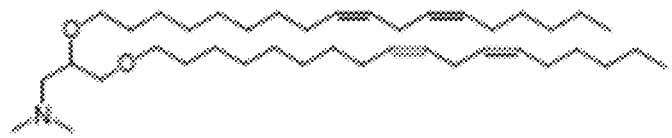
Figure 2:
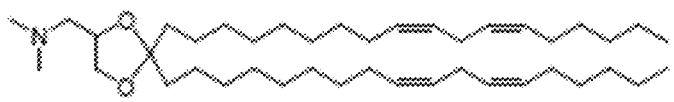
Figure 2:
Figure 2:
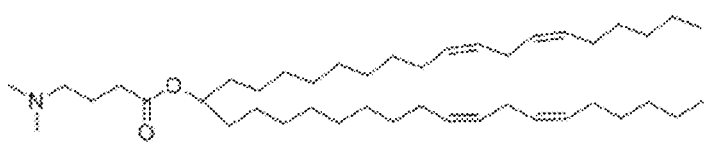
Figure 2:
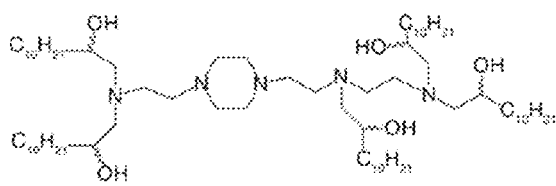

The lipidoid referred to herein as "98N12-5" is disclosed by Akinc et al., Mol Ther. 2009 17:872-879 and is incorporated by reference in its entirety. (See FIG. 2)

The lipidoid referred to herein as "C12-200" is disclosed by Love et al., Proc Natl Acad Sci USA. 2010 107:1864-1869 (see FIG. 2) and Liu and Huang, Molecular Therapy. 2010 669-670 (see FIG. 2); both of which are herein incorporated by reference in their entirety. The lipidoid formulations can include particles comprising either 3 or 4 or more components in addition to oncology-related polynucleotide, primary construct, or mmRNA. As an example, formulations with certain lipidoids, include, but are not limited to, 98N12-5 and may contain 42% lipidoid, 48% cholesterol and 10% PEG (C14 alkyl chain length). As another example, formulations with certain lipidoids, include, but are not limited to, C, 12-200 and may contain 50% lipidoid, 10% disteroylphosphatidyl choline, 38.5% cholesterol, and 1.5% PEG-DMG.

In one embodiment, a oncology-related polynucleotide, primary construct, or mmRNA formulated with a lipidoid for systemic intravenous administration can target the liver. For example, a final optimized intravenous formulation using a oncology-related polynucleotide, primary construct, or mmRNA, and comprising a lipid molar composition of 42% 98N12-5, 48% cholesterol, and 10% PEG-lipid with a final weight ratio of about 7.5 to 1 total lipid to oncology-related polynucleotide, primary construct, or mmRNA, and a C14 alkyl chain length on the PEG lipid, with a mean particle size of roughly 50-60 nm, can result in the distribution of the formulation to be greater than 90% to the liver. (see, Akinc et al., Mol Ther. 2009 17:872-879; herein incorporated by reference in its entirety). In another example, an intravenous formulation using a C12-200 (see U.S. provisional application 61/175,770 and published international application WO2010129709, each of which is herein incorporated by reference in their entirety) lipidoid may have a molar ratio of 50/10/38.5/1.5 of C12-200/disteroylphosphatidyl choline/cholesterol/PEG-DMG, with a weight ratio of 7 to 1 total lipid to oncology-related polynucleotide, primary construct, or mmRNA, and a mean particle size of 80 nm may be effective to deliver oncology-related polynucleotide, primary construct, or mmRNA to hepatocytes (see, Love et al., Proc Natl Acad Sci USA. 2010 107:1864-1869 herein incorporated by reference in its entirety). In another embodiment, an MD1 lipidoid-containing formulation may be used to effectively deliver oncology-related polynucleotide, primary construct, or mmRNA to hepatocytes in vivo. The characteristics of optimized lipidoid formulations for intramuscular or subcutaneous routes may vary significantly depending on the target cell type and the ability of formulations to diffuse through the extracellular matrix into the blood stream. While a particle size of less than 150 nm may be desired for effective hepatocyte delivery due to the size of the endothelial fenestrae (see, Akinc et al., Mol Ther. 2009 17:872-879 herein incorporated by reference in its entirety), use of a lipidoid-formulated oncology-related polynucleotide, primary construct, or mmRNA to deliver the formulation to other cells types including, but not limited to, endothelial cells, myeloid cells, and muscle cells may not be similarly size-limited. Use of lipidoid formulations to deliver siRNA in vivo to other non-hepatocyte cells such as myeloid cells and endothelium has been reported (see Akinc et al., Nat Biotechnol. 2008 26:561-569; Leuschner et al., Nat Biotechnol. 2011 29:1005-1010; Cho et al. Adv. Funct. Mater. 2009 19:3112-3118; 8$^{th}$ International Judah Folkman Conference, Cambridge, Mass. Oct. 8-9, 2010; each of which is herein incorporated by reference in its entirety). Effective delivery to myeloid cells, such as monocytes, lipidoid formulations may have a similar component molar ratio. Different ratios of lipidoids and other components including, but not limited to, disteroylphosphatidyl choline, cholesterol and PEG-DMG, may be used to optimize the formulation of the oncology-related polynucleotide, primary construct, or mmRNA for delivery to different cell types including, but not limited to, hepatocytes, myeloid cells, muscle cells, etc. For example, the component molar ratio may include, but is not limited to, 50% C, 12-200, 10% disteroylphosphatidyl choline, 38.5% cholesterol, and %1.5 PEG-DMG (see Leuschner et al., Nat Biotechnol 2011 29:1005-1010; herein incorporated by reference in its entirety). The use of lipidoid formulations for the localized delivery of nucleic acids to cells (such as, but not limited to, adipose cells and muscle cells) via either subcutaneous or intramuscular delivery, may not require all of the formulation components desired for systemic delivery, and as such may comprise only the lipidoid and the oncology-related polynucleotide, primary construct, or mmRNA.

Combinations of different lipidoids may be used to improve the efficacy of oncology-related polynucleotide, primary construct, or mmRNA directed protein production as the lipidoids may be able to increase cell transfection by the oncology-related polynucleotide, primary construct, or mmRNA; and/or increase the translation of encoded protein (see Whitehead et al., Mol. Ther. 2011, 19:1688-1694, herein incorporated by reference in its entirety).

Liposomes, Lipoplexes, and Lipid Nanoparticles

The oncology-related polynucleotide, primary construct, and mmRNA of the invention can be formulated using one or more liposomes, lipoplexes, or lipid nanoparticles. In one embodiment, pharmaceutical compositions of polynucleotide, primary construct, or mmRNA include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the oncology-related polynucleotide, primary construct, or mmRNA. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In one embodiment, pharmaceutical compositions may include liposomes which may be formed to deliver mmRNA which may encode at least one immunogen. The mmRNA may be encapsulated by the liposome and/or it may be contained in an aqueous core which may then be encapsulated by the liposome (see International Pub. Nos. WO2012031046, WO2012031043, WO2012030901 and WO2012006378; each of which is herein incorporated by reference in their entirety). In another embodiment, the mmRNA which may encode an immunogen may be formulated in a cationic oil-in-water emulsion where the emulsion particle comprises an oil core and a cationic lipid which can interact with the mmRNA anchoring the molecule to the emulsion particle (see International Pub. No. WO2012006380; herein incorporated by reference in its entirety). In yet another embodiment, the lipid formulation may include at least cationic lipid, a lipid which may enhance transfection and a least one lipid which contains a hydrophilic head group linked to a lipid moiety (International Pub. No. WO2011076807 and U.S. Pub. No. 20110200582; each of which is herein incorporated by reference in their entirety). In another embodiment, the oncology-related polynucleotides, primary constructs and/or mmRNA encoding an immunogen may be formulated in a lipid vesicle which may have crosslinks between functionalized lipid bilayers (see U.S. Pub. No. 20120177724, herein incorporated by reference in its entirety).

In one embodiment, the oncology-related polynucleotides, primary constructs and/or mmRNA may be formulated in a lipid vesicle which may have crosslinks between functionalized lipid bilayers.

In one embodiment, the oncology-related polynucleotides, primary constructs and/or mmRNA may be formulated in a liposome comprising a cationic lipid. The liposome may have a molar ratio of nitrogen atoms in the cationic lipid to the phophates in the RNA (N:P ratio) of between 1:1 and 20:1 as described in International Publication No. WO2013006825, herein incorporated by reference in its entirety. In another embodiment, the liposome may have a N:P ratio of greater than 20:1 or less than 1:1.

In one embodiment, the oncology-related polynucleotides, primary constructs and/or mmRNA may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine and the cationic peptides described in International Pub. No. WO2012013326; herein incorporated by reference in its entirety. In another embodiment, the oncology-related polynucleotides, primary constructs and/or mmRNA may be formulated in a lipid-polycation complex which may further include a neutral lipid such as, but not limited to, cholesterol or dioleoyl phosphatidylethanolamine (DOPE).

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety).

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain 1-5% of the lipid molar ratio of PEG-c-DOMG as compared to the cationic lipid, DSPC and cholesterol. In another embodiment the PEG-c-DOMG may be replaced with a PEG lipid such as, but not limited to, PEG-DSG (1,2-Distearoyl-sn-glycerol, methoxypolyethylene glycol) or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C, 12-200 and DLin-KC2-DMA.

In one embodiment, the polynucleotides, primary constructs or mmRNA may be formulated in a lipid nanoparticle such as those described in International Publication No. WO2012170930, herein incorporated by reference in its entirety.

In one embodiment, the cationic lipid may be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865 and WO2008103276, U.S. Pat. Nos. 7,893,302, 7,404,969 and 8,283,333 and US Patent Publication No. US20100036115 and US20120202871; each of which is herein incorporated by reference in their entirety. In another embodiment, the cationic lipid may be selected from, but not limited to, formula A described in International Publication Nos. WO2012040184, WO2011153120, WO2011149733, WO2011090965, WO2011043913, WO2011022460, WO2012061259, WO2012054365 and WO2012044638; each of which is herein incorporated by reference in their entirety. In yet another embodiment, the cationic lipid may be selected from, but not limited to, formula CLI-CLXXIX of International Publication No. WO2008103276, formula CLI-CLXXIX of U.S. Pat. No. 7,893,302, formula CLI-CLXXXII of U.S. Pat. No. 7,404,969 and formula I-V1 of US Patent Publication No. US20100036115; each of which is herein incorporated by reference in their entirety. As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-16,19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimethyloctacosa-19,22-dien-9-amine, (18Z,21Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21Z,24Z)—N,N-dimethyltriaconta-21,24-dien-9-amine, (18Z)—N,N-dimethylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyleptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine,N,N-dimethyl-1-[(1S,2S)-2-{[(1R,2R)-2-pentylcyclopropyl]methyl}cyclopropyl]nonadecan-10-amine,N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl]heptyl}dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy) propan-2-amine; (2S)—N,N-dimethyl-1-[(6Z,9Z,12Z)-octadeca-6,9,12-trien-1- yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy) propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In one embodiment, the lipid may be a cleavable lipid such as those described in International Publication No. WO2012170889, herein incorporated by reference in its entirety.

In one embodiment, the cationic lipid may be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724 and WO201021865; each of which is herein incorporated by reference in their entirety.

In one embodiment, the LNP formulations of the oncology-related polynucleotides, primary constructs and/or mmRNA may contain PEG-c-DOMG at 3% lipid molar ratio. In another embodiment, the LNP formulations polynucleotides, primary constructs and/or mmRNA may contain PEG-c-DOMG at 1.5% lipid molar ratio.

In one embodiment, the pharmaceutical compositions of the oncology-related polynucleotides, primary constructs and/or mmRNA may include at least one of the PEGylated lipids described in International Publication No. 2012099755, herein incorporated by reference.

In one embodiment, the LNP formulation may contain PEG-DMG 2000 (1,2-dimyristoyl-sn-glycero-3-phophoethanolamine-N-[methoxy(polyethylene glycol)-2000]). In one embodiment, the LNP formulation may contain PEG-DMG 2000, a cationic lipid known in the art and at least one other component. In another embodiment, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA vaccines, PNAS 2012; PMID: 22908294; herein incorporated by reference in its entirety). As another non-limiting example, modified RNA described herein may be formulated in a nanoparticle to be delivered by a parenteral route as described in U.S. Pub. No. 20120207845; herein incorporated by reference in its entirety.

In one embodiment, the LNP formulation may be formulated by the methods described in International Publication Nos. WO2011127255 or WO2008103276, each of which is herein incorporated by reference in their entirety. As a non-limiting example, modified RNA described herein may be encapsulated in LNP formulations as described in WO2011127255 and/or WO2008103276; each of which is herein incorporated by reference in their entirety.

In one embodiment, LNP formulations described herein may comprise a polycationic composition. As a non-limiting example, the polycationic composition may be selected from formula 1-60 of US Patent Publication No. US20050222064; herein incorporated by reference in its entirety. In another embodiment, the LNP formulations comprising a polycationic composition may be used for the delivery of the modified RNA described herein in vivo and/or in vitro.

In one embodiment, the LNP formulations described herein may additionally comprise a permeability enhancer molecule. Non-limiting permeability enhancer molecules are described in US Patent Publication No. US20050222064; herein incorporated by reference in its entirety.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12) 1708-1713); herein incorporated by reference in its entirety) and hyaluronan-coated liposomes (Quiet Therapeutics, Israel).

The nanoparticle formulations may be a carbohydrate nanoparticle comprising a carbohydrate carrier and a modified nucleic acid molecule (e.g., mmRNA). As a non-limiting example, the carbohydrate carrier may include, but is not limited to, an anhydride-modified phytoglycogen or glycogen-type material, phtoglycogen octenyl succinate, phytoglycogen beta-dextrin, anhydride-modified phytoglycogen beta-dextrin. (See e.g., International Publication No. WO2012109121; herein incorporated by reference in its entirety).

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the internal ester linkage may be located on either side of the saturated carbon. Non-limiting examples of reLNPs include,

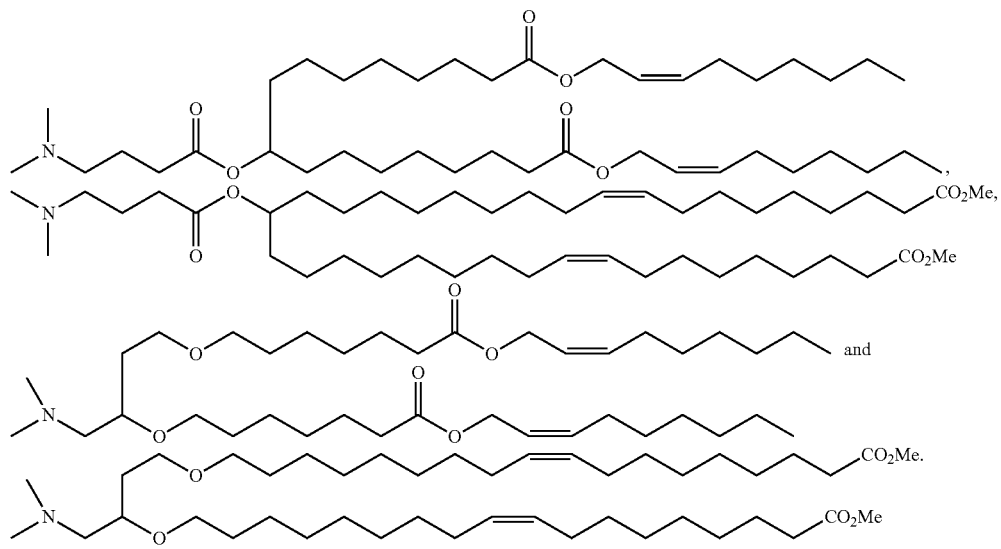

In one embodiment, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA and/or a primary construct described herein. In one embodiment, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosla tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104(5):1482-487; Lai et al. Adv Drug Deliv Rev. 2009 61(2): 158-171; each of which is herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier may be made as described in U.S. Pat. No. 8,241,670, herein incorporated by reference in its entirety.

The lipid nanoparticle engineered to penetrate mucus may comprise a polymeric material (i.e. a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material may be biodegradable and/or biocompatible. The polymeric material may additionally be irradiated. As a non-limiting example, the polymeric material may be gamma irradiated (See e.g., International App. No. WO201282165, herein incorporated by reference in its entirety). Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly(lactic acid-co-glycolic acid) (PLGA), poly(L-lactic acid-co-glycolic acid) (PLLGA), poly(D,L-lactide) (PDLA), poly(L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly(ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth)acrylate) (PMMA), poly(ethyl(meth)acrylate), poly(butyl(meth)acrylate), poly(isobutyl(meth)acrylate), poly(hexyl(meth)acrylate), poly(isodecyl(meth)acrylate), poly(lauryl(meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), and trimethylene carbonate, polyvinylpyrrolidone. The lipid nanoparticle may be coated or associated with a co-polymer such as, but not limited to, a block co-polymer (such as, but not limited to, a branched polyether-polyamide block copolymer described in International Publication No. WO2013012476, herein incorporated by reference in its entirety), and (poly(ethylene glycol))-(poly(propylene oxide))-(poly(ethylene glycol)) triblock copolymer (see e.g., US Publication 20120121718 and US Publication 20100003337 and U.S. Pat. No. 8,263,665; each of which is herein incorporated by reference in their entirety). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; herein incorporated by reference in its entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, mmRNA, anionic proteins (e.g., bovine serum albumin), surfactants (e.g., cationic surfactants such as for example dimethyldioctadecylammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see e.g., US Publication 20100215580 and US Publication 20080166414; each of which is herein incorporated by reference in their entirety).

The mucus penetrating lipid nanoparticles may comprise at least one mmRNA described herein. The mmRNA may be encapsulated in the lipid nanoparticle and/or disposed on the surface of the paricle. The mmRNA may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion which may increase the delivery of the mucus penetrating lipid nanoparticles to the mucosal tissue.

In one embodiment, the oncology-related polynucleotide, primary construct, or mmRNA is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J. Immunother. 2009 32:498-507; Weide et al. J. Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles *Hum Gene Ther.* 2008 19:125-132; all of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319:627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, *Front Biosci.* 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104: 4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the oncology-related polynucleotide, primary construct, or mmRNA is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; herein incorporated by reference in its entirety).

Liposomes, lipoplexes, or lipid nanoparticles may be used to improve the efficacy of polynucleotide, primary construct, or mmRNA directed protein production as these formulations may be able to increase cell transfection by the oncology-related polynucleotide, primary construct, or mmRNA; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles may also be used to increase the stability of the oncology-related polynucleotide, primary construct, or mmRNA.

In one embodiment, the polynucleotides, primary constructs, and/or the mmRNA of the present invention can be formulated for controlled release and/or targeted delivery. As used herein, "controlled release" refers to a pharmaceutical composition or compound release profile that conforms to a particular pattern of release to effect a therapeutic outcome. In one embodiment, the polynucleotides, primary constructs or the mmRNA may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9 or greater than 99.999% of the pharmaceutical composition or compound of the invention may be enclosed, surrounded or encased within the delivery agent. "Partially encapsulation" means that less than 10, 10, 20, 30, 40 50 or less of the pharmaceutical composition or compound of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In one embodiment, the controlled release formulation may include, but is not limited to, tri-block co-polymers. As a non-limiting example, the formulation may include two different types of tri-block co-polymers (International Pub. No. WO2012131104 and WO2012131106; each of which is herein incorporated by reference in its entirety).

In another embodiment, the polynucleotides, primary constructs, or the mmRNA may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In another embodiment, the lipid nanoparticle may be encapsulated into any polymer known in the art which may form a gel when injected into a subject. As another non-limiting example, the lipid nanoparticle may be encapsulated into a polymer matrix which may be biodegradable.

In one embodiment, the oncology-related polynucleotide, primary construct, or mmRNA formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In one embodiment, the controlled release and/or targeted delivery formulation may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In one embodiment, the polynucleotides, primary constructs, and/or the mmRNA of the present invention may be encapsulated in a therapeutic nanoparticle. Therapeutic nanoparticles may be formulated by methods described herein and known in the art such as, but not limited to, International Pub Nos. WO2010005740, WO2010030763, WO2010005721, WO2010005723, WO2012054923, US Pub. Nos. US20110262491, US20100104645, US20100087337, US20100068285, US20110274759, US20100068286 and US20120288541 and U.S. Pat. Nos. 8,206,747, 8,293,276, 8,318,208 and 8,318,211 each of which is herein incorporated by reference in their entirety. In another embodiment, therapeutic polymer nanoparticles may be identified by the methods described in US Pub No. US20120140790, herein incorporated by reference in its entirety.

In one embodiment, the therapeutic nanoparticle may be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the polynucleotides, primary constructs, and mmRNA of the present invention (see International Pub No. 2010075072 and US Pub No. US20100216804, US20110217377 and US20120201859, each of which is herein incorporated by reference in their entirety).

In one embodiment, the therapeutic nanoparticles may be formulated to be target specific. As a non-limiting example, the therapeutic nanoparticles may include a corticosteroid (see International Pub. No. WO2011084518; herein incorporated by reference in its entirety). In one embodiment, the therapeutic nanoparticles may be formulated to be cancer specific. As a non-limiting example, the therapeutic nanoparticles may be formulated in nanoparticles described in International Pub No. WO2008121949, WO2010005726, WO2010005725, WO2011084521 and US Pub No. US20100069426, US20120004293 and US20100104655, each of which is herein incorporated by reference in their entirety.

In one embodiment, the nanoparticles of the present invention may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester) or combinations thereof.

As a non-limiting example the therapeutic nanoparticle comprises a PLGA-PEG block copolymer (see US Pub. No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012166923, each of which is herein incorporated by reference in its entirety).

In one embodiment, the therapeutic nanoparticle may comprise a multiblock copolymer (See e.g., U.S. Pat. Nos. 8,263,665 and 8,287,910; each of which is herein incorporated by reference in its entirety).

In one embodiment, the block copolymers described herein may be included in a polyion complex comprising a non-polymeric micelle and the block copolymer. (See e.g., U.S. Pub. No. 20120076836; herein incorporated by reference in its entirety).

In one embodiment, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the therapeutic nanoparticles may comprise at least one cationic polymer described herein and/or known in the art.

In one embodiment, the therapeutic nanoparticles may comprise at least one amine-containing polymer such as, but not limited to polylysine, polyethylene imine, poly(amidoamine) dendrimers, poly(beta-amino esters) (See e.g., U.S. Pat. No. 8,287,849; herein incorporated by reference in its entirety) and combinations thereof.

In one embodiment, the therapeutic nanoparticles may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In another embodiment, the therapeutic nanoparticle may include a conjugation of at least one targeting ligand. The targeting ligand may be any ligand known in the art such as, but not limited to, a monoclonal antibody. (Kirpotin et al, Cancer Res. 2006 66:6732-6740; herein incorporated by reference in its entirety).

In one embodiment, the therapeutic nanoparticle may be formulated in an aqueous solution which may be used to target cancer (see International Pub No. WO2011084513 and US Pub No. US20110294717, each of which is herein incorporated by reference in their entirety).

In one embodiment, the polynucleotides, primary constructs, or mmRNA may be encapsulated in, linked to and/or associated with synthetic nanocarriers. Synthetic nanocarriers include, but are not limited to, those described in International Pub. Nos. WO2010005740, WO2010030763, WO201213501, WO2012149252, WO2012149255, WO2012149259, WO2012149265, WO2012149268, WO2012149282, WO2012149301, WO2012149393, WO2012149405, WO2012149411, WO2012149454 and WO2013019669 and US Pub. Nos. US20110262491, US20100104645, US20100087337 and US20120244222, each of which is herein incorporated by reference in their entirety. The synthetic nanocarriers may be formulated using methods known in the art and/or described herein. As a non-limiting example, the synthetic nanocarriers may be formulated by the methods described in International Pub Nos. WO2010005740, WO2010030763 and WO201213501 and US Pub. Nos. US20110262491, US20100104645, US20100087337 and US2012024422, each of which is herein incorporated by reference in their entirety. In another embodiment, the synthetic nanocarrier formulations may be lyophilized by methods described in International Pub. No. WO2011072218 and U.S. Pat. No. 8,211,473; each of which is herein incorporated by reference in their entirety.

In one embodiment, the synthetic nanocarriers may contain reactive groups to release the oncology-related polynucleotides, primary constructs and/or mmRNA described herein (see International Pub. No. WO20120952552 and US Pub No. US20120171229, each of which is herein incorporated by reference in their entirety).

In one embodiment, the synthetic nanocarriers may contain an immunostimulatory agent to enhance the immune response from delivery of the synthetic nanocarrier. As a non-limiting example, the synthetic nanocarrier may comprise a Th1 immunostimulatory agent which may enhance a Th1-based response of the immune system (see International Pub No. WO2010123569 and US Pub. No. US20110223201, each of which is herein incorporated by reference in its entirety).

In one embodiment, the synthetic nanocarriers may be formulated for targeted release. In one embodiment, the synthetic nanocarrier is formulated to release the oncology-related polynucleotides, primary constructs and/or mmRNA at a specified pH and/or after a desired time interval. As a non-limiting example, the synthetic nanoparticle may be formulated to release the oncology-related polynucleotides, primary constructs and/or mmRNA after 24 hours and/or at a pH of 4.5 (see International Pub. Nos. WO2010138193 and WO2010138194 and US Pub Nos. US20110020388 and US20110027217, each of which is herein incorporated by reference in their entireties).

In one embodiment, the synthetic nanocarriers may be formulated for controlled and/or sustained release of the oncology-related polynucleotides, primary constructs and/or mmRNA described herein. As a non-limiting example, the synthetic nanocarriers for sustained release may be formulated by methods known in the art, described herein and/or as described in International Pub No. WO2010138192 and US Pub No. 20100303850, each of which is herein incorporated by reference in their entirety.

In one embodiment, the synthetic nanocarrier may be formulated for use as a vaccine. In one embodiment, the synthetic nanocarrier may encapsulate at least one polynucleotide, primary construct and/or mmRNA which encode at least one antigen. As a non-limiting example, the synthetic nanocarrier may include at least one antigen and an excipient for a vaccine dosage form (see International Pub No.

WO2011150264 and US Pub No. US20110293723, each of which is herein incorporated by reference in their entirety). As another non-limiting example, a vaccine dosage form may include at least two synthetic nanocarriers with the same or different antigens and an excipient (see International Pub No. WO2011150249 and US Pub No. US20110293701, each of which is herein incorporated by reference in their entirety). The vaccine dosage form may be selected by methods described herein, known in the art and/or described in International Pub No. WO2011150258 and US Pub No. US20120027806, each of which is herein incorporated by reference in their entirety).

In one embodiment, the synthetic nanocarrier may comprise at least one polynucleotide, primary construct and/or mmRNA which encodes at least one adjuvant. As non-limiting example, the adjuvant may comprise dimethyldioctadecylammonium-bromide, dimethyldioctadecylammonium-chloride, dimethyldioctadecylammonium-phosphate or dimethyldioctadecylammonium-acetate (DDA) and an apolar fraction or part of said apolar fraction of a total lipid extract of a mycobacterium (See e.g, U.S. Pat. No. 8,241,610; herein incorporated by reference in its entirety). In another embodiment, the synthetic nanocarrier may comprise at least one polynucleotide, primary construct and/or mmRNA and an adjuvant. As a non-limiting example, the synthetic nanocarrier comprising and adjuvant may be formulated by the methods described in International Pub No. WO2011150240 and US Pub No. US20110293700, each of which is herein incorporated by reference in its entirety.

In one embodiment, the synthetic nanocarrier may encapsulate at least one polynucleotide, primary construct and/or mmRNA which encodes a peptide, fragment or region from a virus. As a non-limiting example, the synthetic nanocarrier may include, but is not limited to, the nanocarriers described in International Pub No. WO2012024621, WO201202629, WO2012024632 and US Pub No. US20120064110, US20120058153 and US20120058154, each of which is herein incorporated by reference in their entirety.

In one embodiment, the synthetic nanocarrier may be coupled to a polynucleotide, primary construct or mmRNA which may be able to trigger a humoral and/or cytotoxic T lymphocyte (CTL) response (See e.g., International Publication No. WO2013019669, herein incorporated by reference in its entirety).

In one embodiment, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Pub. No. 20120282343; herein incorporated by reference in its entirety.

Polymers, Biodegradable Nanoparticles, and Core-Shell Nanoparticles

The oncology-related polynucleotide, primary construct, and mmRNA of the invention can be formulated using natural and/or synthetic polymers. Non-limiting examples of polymers which may be used for delivery include, but are not limited to, DYNAMIC POLYCONJUGATE® (Arrowhead Reasearch Corp., Pasadena, Calif.) formulations from MIRUS® Bio (Madison, Wis.) and Roche Madison (Madison, Wis.), PHASERX® polymer formulations such as, without limitation, SMARTT POLYMER TECHNOLOGY™ (Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX® (Seattle, Wash.).

A non-limiting example of chitosan formulation includes a core of positively charged chitosan and an outer portion of negatively charged substrate (U.S. Pub. No. 20120258176; herein incorporated by reference in its entirety). Chitosan includes, but is not limited to N-trimethyl chitosan, mono-N-carboxymethyl chitosan (MCC), N-palmitoyl chitosan (NPCS), EDTA-chitosan, low molecular weight chitosan, chitosan derivatives, or combinations thereof.

In one embodiment, the polymers used in the present invention have undergone processing to reduce and/or inhibit the attachement of unwanted substances such as, but not limited to, bacteria, to the surface of the polymer. The polymer may be processed by methods known and/or described in the art and/or described in International Pub. No. WO2012150467, herein incorporated by reference in its entirety.

A non-limiting example of PLGA formulations include, but are not limited to, PLGA injectable depots (e.g., ELIGARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles Hum Gene Ther. 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles. The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887; herein incorporated by reference in its entirety). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci U S A. 2007 104:12982-12887; herein incorporated by reference in its entirety). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLII gene product in transferrin receptor-expressing Ewing's sarcoma tumor cells (Hu-Lieskovan et al., Cancer Res. 2005 65: 8984-8982; herein incorporated by reference in its entirety) and siRNA formulated in these nanoparticles was well tolerated in non-human primates (Heidel et al., Proc Natl Acad Sci USA 2007 104: 5715-21; herein incorporated by reference in its entirety). Both of these delivery strategies incorporate rational approaches using both targeted delivery and endosomal escape mechanisms.

The polymer formulation can permit the sustained or delayed release of polynucleotide, primary construct, or mmRNA (e.g., following intramuscular or subcutaneous injection). The altered release profile for the oncology-related polynucleotide, primary construct, or mmRNA can result in, for example, translation of an encoded protein over an extended period of time. The polymer formulation may also be used to increase the stability of the oncology-related polynucleotide, primary construct, or mmRNA. Biodegradable polymers have been previously used to protect nucleic acids other than mmRNA from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem. Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132; Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; each of which is herein incorporated by reference in its entirety).

In one embodiment, the pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

As a non-limiting example modified mRNA may be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradeable, biocompatible polymers which are used extensively in pre-clinical sustained release implant applications (e.g., extended release products Ocusert a pilocarpine ophthalmic insert for glaucoma or progestasert a sustained release progesterone intrauterine deivce; transdermal delivery systems Testoderm, Duragesic and Seleginine; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device which can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic interaction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-668; Davis, Nature 2010 464:1067-1070; each of which is herein incorporated by reference in its entirety).

The modified nucleic acid, and mmRNA of the invention may be formulated with or in a polymeric compound. The polymer may include at least one polymer such as, but not limited to, polyethenes, polyethylene glycol (PEG), poly(1-lysine) (PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, elastic biodegradable polymer, biodegradable block copolymer, biodegradable random copolymer, biodegradable polyester copolymer, biodegradable polyester block copolymer, biodegradable polyester block random copolymer, multiblock copolymers, linear biodegradable copolymer, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly (4-hydroxy-L-proline ester), acrylic polymers, amine-containing polymers, dextran polymers, dextran polymer derivatives or combinations thereof.

As a non-limiting example, the modified nucleic acid or mmRNA of the invention may be formulated with the polymeric compound of PEG grafted with PLL as described in U.S. Pat. No. 6,177,274; herein incorporated by reference in its entirety. The formulation may be used for transfecting cells in vitro or for in vivo delivery of the modified nucleic acid and mmRNA. In another example, the modified nucleic acid and mmRNA may be suspended in a solution or medium with a cationic polymer, in a dry pharmaceutical composition or in a solution that is capable of being dried as described in U.S. Pub. Nos. 20090042829 and 20090042825; each of which are herein incorporated by reference in their entireties.

As another non-limiting example the oncology-related polynucleotides, primary constructs or mmRNA of the invention may be formulated with a PLGA-PEG block copolymer (see US Pub. No. US20120004293 and U.S. Pat. No. 8,236, 330, herein incorporated by reference in their entireties) or PLGA-PEG-PLGA block copolymers (See U.S. Pat. No. 6,004,573, herein incorporated by reference in its entirety). As a non-limiting example, the oncology-related polynucleotides, primary constructs or mmRNA of the invention may be formulated with a diblock copolymer of PEG and PLA or PEG and PLGA (see U.S. Pat. No. 8,246,968, herein incorporated by reference in its entirety).

A polyamine derivative may be used to deliver nucleic acids or to treat and/or prevent a disease or to be included in an implantable or injectable device (U.S. Pub. No. 20100260817 herein incorporated by reference in its entirety). As a non-limiting example, a pharmaceutical composition may include the modified nucleic acids and mmRNA and the polyamine derivative described in U.S. Pub. No. 20100260817 (the contents of which are incorporated herein by reference in its entirety. As a non-limiting example the oncology-related polynucleotides, primary constructs and mmRNA of the present invention may be delivered using a polyaminde polymer such as, but not limited to, a polymer comprising a 1,3-dipolar addition polymer prepared by combining a carbohydrate diazide monomer with a dilkyne unite comprising oligoamines (U.S. Pat. No. 8,236,280; herein incorporated by reference in its entirety).

In one embodiment, the oncology-related polynucleotides, primary constructs or mmRNA of the present invention may be formulated with at least one polymer and/or derivatives thereof described in International Publication Nos. WO2011115862, WO2012082574 and WO2012068187 and U.S. Pub. No. 20120283427, each of which are herein incorporated by reference in their entireties. In another embodiment, the modified nucleic acid or mmRNA of the present invention may be formulated with a polymer of formula Z as described in WO2011115862, herein incorporated by reference in its entirety. In yet another embodiment, the modified nucleic acid or mmRNA may be formulated with a polymer of formula Z, Z' or Z" as described in International Pub. Nos. WO2012082574 or WO2012068187 and U.S. Pub. No. 2012028342, each of which are herein incorporated by reference in their entireties. The polymers formulated with the modified RNA of the present invention may be synthesized by the methods described in International Pub. Nos. WO2012082574 or WO2012068187, each of which are herein incorporated by reference in their entireties.

The oncology-related polynucleotides, primary constructs or mmRNA of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

Formulations of oncology-related polynucleotides, primary constructs or mmRNA of the invention may include at least one amine-containing polymer such as, but not limited to polylysine, polyethylene imine, poly(amidoamine) dendrimers or combinations thereof.

For example, the modified nucleic acid or mmRNA of the invention may be formulated in a pharmaceutical compound including a poly(alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer may be made by methods known in the art and/or described in U.S. Pat. No. 6,696,038, U.S. App. Nos. 20030073619 and 20040142474 each of which is herein incorporated by reference in their entireties. The poly(alkylene imine) may be made using methods known in the art and/or as described in U.S. Pub. No. 20100004315, herein incorporated by reference in its entirety. The biodegradable polymer, biodegradable block copolymer, the biodegradable random copolymer, biodegradable polyester block copolymer, biodegradable polyester polymer, or biodegradable polyester random copolymer may be made using methods known in the art and/or as described in U.S. Pat. Nos. 6,517,869 and 6,267,987, the contents of which are each incorporated herein by reference in their entirety. The linear biodegradable copolymer may be made using methods known in the art and/or as described in U.S. Pat. No. 6,652,886. The PAGA polymer may be made using methods known in the art and/or as described in U.S. Pat. No. 6,217,912 herein incorporated by reference in its entirety. The PAGA polymer may be copolymerized to form a copolymer or block copolymer with polymers such as but not limited to, poly-L-lysine, polyargine, polyornithine, histones, avidin, protamines, polylactides and poly(lactide-co-glycolides). The biodegradable cross-linked cationic multi-block copolymers may be made my methods known in the art and/or as described in U.S. Pat. No. 8,057,821 or U.S. Pub. No. 2012009145 each of which are herein incorporated by reference in their entireties. For example, the multi-block copolymers may be synthesized using linear polyethyleneimine (LPEI) blocks which have distinct patterns as compared to branched polyethyleneimines. Further, the composition or pharmaceutical composition may be made by the methods known in the art, described herein, or as described in U.S. Pub. No. 20100004315 or U.S. Pat. Nos. 6,267,987 and 6,217,912 each of which are herein incorporated by reference in their entireties.

The polynucleotides, primary constructs, and mmRNA of the invention may be formulated with at least one degradable polyester which may contain polycationic side chains. Degradeable polyesters include, but are not limited to, poly (serine ester), poly(L-lactide-co-L-lysine), poly(4-hydroxy-L-proline ester), and combinations thereof. In another embodiment, the degradable polyesters may include a PEG conjugation to form a PEGylated polymer.

The polynucleotides, primary construct, mmRNA of the invention may be formulated with at least one crosslinkable polyester. Crosslinkable polyesters include those known in the art and described in US Pub. No. 20120269761, herein incorporated by reference in its entirety.

In one embodiment, the polymers described herein may be conjugated to a lipid-terminating PEG. As a non-limiting example, PLGA may be conjugated to a lipid-terminating PEG forming PLGA-DSPE-PEG. As another non-limiting example, PEG conjugates for use with the present invention are described in International Publication No. WO2008103276, herein incorporated by reference in its entirety. The polymers may be conjugated using a ligand conjugate such as, but not limited to, the conjugates described in U.S. Pat. No. 8,273,363, herein incorporated by reference in its entirety.

In one embodiment, the modified RNA described herein may be conjugated with another compound. Non-limiting examples of conjugates are described in U.S. Pat. Nos. 7,964,578 and 7,833,992, each of which are herein incorporated by reference in their entireties. In another embodiment, modified RNA of the present invention may be conjugated with conjugates of formula 1-122 as described in U.S. Pat. Nos. 7,964,578 and 7,833,992, each of which are herein incorporated by reference in their entireties. The oncology-related polynucleotides, primary constructs and/or mmRNA described herein may be conjugated with a metal such as, but not limited to, gold. (See e.g., Giljohann et al. Journ. Amer. Chem. Soc. 2009 131(6): 2072-2073; herein incorporated by reference in its entirety). In another embodiment, the oncology-related polynucleotides, primary constructs and/or mmRNA described herein may be conjugated and/or encapsulated in gold-nanoparticles. (International Pub. No. WO201216269 and U.S. Pub. No. 20120302940; each of which is herein incorporated by reference in its entirety).

As described in U.S. Pub. No. 20100004313, herein incorporated by reference in its entirety, a gene delivery composition may include a nucleotide sequence and a poloxamer. For example, the modified nucleic acid and mmRNA of the present inveition may be used in a gene delivery composition with the poloxamer described in U.S. Pub. No. 20100004313.

In one embodiment, the polymer formulation of the present invention may be stabilized by contacting the polymer formulation, which may include a cationic carrier, with a cationic lipopolymer which may be covalently linked to cholesterol and polyethylene glycol groups. The polymer formulation may be contacted with a cationic lipopolymer using the methods described in U.S. Pub. No. 20090042829 herein incorporated by reference in its entirety. The cationic carrier may include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane(DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B—[N—(N',N'-Dimethylaminoethane)-carbamoyl]Cholesterol Hydrochloride (DC-Cholesterol HCl) diheptadecylamidoglycyl spermidine (DOGS), N,N-distearyl-N,N-dimethylammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof.

The oncology-related polynucleotides, primary constructs and/or mmRNA of the invention may be formulated in a polyplex of one or more polymers (U.S. Pub. No. 20120237565 and 20120270927; each of which is herein incorporated by reference in its entirety). In one embodiment, the polyplex comprises two or more cationic polymers. The catioinic polymer may comprise a poly(ethylene imine) (PEI) such as linear PEI.

The oncology-related polynucleotide, primary construct, and mmRNA of the invention can also be formulated as a nanoparticle using a combination of polymers, lipids, and/or other biodegradable agents, such as, but not limited to, calcium phosphate. Components may be combined in a core-shell, hybrid, and/or layer-by-layer architecture, to allow for fine-tuning of the nanoparticle so to delivery of the polynucleotide, primary construct and mmRNA may be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety). As a non-limiting example, the nanoparticle may comprise a plurality of polymers such as, but not limited to hydrophilic-hydrophobic polymers (e.g., PEG-PLGA), hydrophobic polymers (e.g., PEG) and/or hydrophilic polymers (International Pub. No. WO20120225129; herein incorporated by reference in its entirety).

Biodegradable calcium phosphate nanoparticles in combination with lipids and/or polymers have been shown to deliver polynucleotides, primary constructs and mmRNA in vivo. In one embodiment, a lipid coated calcium phosphate nanoparticle, which may also contain a targeting ligand such as anisamide, may be used to deliver the polynucleotide, primary construct and mmRNA of the present invention. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol Ther. 2012 20:609-615; herein incorporated by reference in its entirety). This delivery system combines both a targeted nanoparticle and a component to enhance the endosomal escape, calcium phosphate, in order to improve delivery of the siRNA.

In one embodiment, calcium phosphate with a PEG-polyanion block copolymer may be used to delivery polynucleotides, primary constructs and mmRNA (Kazikawa et al., J Contr Rel. 2004 97:345-356; Kazikawa et al., J Contr Rel. 2006 111:368-370; herein incorporated by reference in its entirety).

In one embodiment, a PEG-charge-conversional polymer (Pitella et al., Biomaterials. 2011 32:3106-3114) may be used to form a nanoparticle to deliver the oncology-related polynucleotides, primary constructs and mmRNA of the present invention. The PEG-charge-conversional polymer may improve upon the PEG-polyanion block copolymers by being cleaved into a polycation at acidic pH, thus enhancing endosomal escape.

The use of core-shell nanoparticles has additionally focused on a high-throughput approach to synthesize cationic cross-linked nanogel cores and various shells (Siegwart et al., Proc Natl Acad Sci USA. 2011 108:12996-13001). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In one embodiment, a hollow lipid core comprising a middle PLGA layer and an outer neutral lipid layer containing PEG may be used to delivery of the polynucleotide, primary construct and mmRNA of the present invention. As a non-limiting example, in mice bearing a luciferase-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031; herein incorporated by reference in its entirety).

In one embodiment, the lipid nanoparticles may comprise a core of the modified nucleic acid molecules disclosed herein and a polymer shell. The polymer shell may be any of the polymers described herein and are known in the art. In an additional embodiment, the polymer shell may be used to protect the modified nucleic acids in the core.

Core-shell nanoparticles for use with the modified nucleic acid molecules of the present invention are described and may be formed by the methods described in U.S. Pat. No. 8,313,777 herein incorporated by reference in its entirety.

In one embodiment, the core-shell nanoparticles may comprise a core of the modified nucleic acid molecules disclosed herein and a polymer shell. The polymer shell may be any of the polymers described herein and are known in the art. In an additional embodiment, the polymer shell may be used to protect the modified nucleic acid molecules in the core. As a non-limiting example, the core-shell nanoparticle may be used to treat an eye disease or disorder (See e.g. US Publication No. 20120321719, herein incorporated by reference in its entirety).

In one embodiment, the polymer used with the formulations described herein may be a modified polymer (such as, but not limited to, a modified polyacetal) as described in International Publication No. WO2011120053, herein incorporated by reference in its entirety.

Peptides and Proteins

The oncology-related polynucleotide, primary construct, and mmRNA of the invention can be formulated with peptides and/or proteins in order to increase transfection of cells by the oncology-related polynucleotide, primary construct, or mmRNA. In one embodiment, peptides such as, but not limited to, cell penetrating peptides and proteins and peptides that enable intracellular delivery may be used to deliver pharmaceutical formulations. A non-limiting example of a cell penetrating peptide which may be used with the pharmaceutical formulations of the present invention includes a cell-penetrating peptide sequence attached to polycations that facilitates delivery to the intracellular space, e.g., HIV-derived TAT peptide, penetratins, transportans, or hCT derived cell-penetrating peptides (see, e.g., Caron et al., Mol. Ther. 3(3):310-8 (2001); Langel, Cell-Penetrating Peptides: Processes and Applications (CRC Press, Boca Raton Fla., 2002); El-Andaloussi et al., Curr. Pharm. Des. 11(28):3597-611 (2003); and Deshayes et al., Cell. Mol. Life. Sci. 62(16): 1839-49 (2005), all of which are incorporated herein by reference in their entirety). The compositions can also be formulated to include a cell penetrating agent, e.g., liposomes, which enhance delivery of the compositions to the intracellular space. Polynucleotides, primary constructs, and mmRNA of the invention may be complexed to peptides and/or proteins such as, but not limited to, peptides and/or proteins from Aileron Therapeutics (Cambridge, Mass.) and Permeon Biologics (Cambridge, Mass.) in order to enable intracellular delivery (Cronican et al., ACS Chem. Biol. 2010 5:747-752; McNaughton et al., Proc. Natl. Acad. Sci. USA 2009 106:6111-6116; Sawyer, Chem Biol Drug Des. 2009 73:3-6; Verdine and Hilinski, Methods Enzymol. 2012; 503: 3-33; all of which are herein incorporated by reference in its entirety).

In one embodiment, the cell-penetrating polypeptide may comprise a first domain and a second domain. The first domain may comprise a supercharged polypeptide. The second domain may comprise a protein-binding partner. As used herein, "protein-binding partner" includes, but are not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the oncology-related polynucleotide, primary construct, or mmRNA may be introduced.

Formulations of the including peptides or proteins may be used to increase cell transfection by the oncology-related polynucleotide, primary construct, or mmRNA, alter the biodistribution of the oncology-related polynucleotide, primary construct, or mmRNA (e.g., by targeting specific tissues or cell types), and/or increase the translation of encoded protein. (See e.g., International Pub. No. WO2012110636; herein incorporated by reference in its entirety).

Cells

The oncology-related polynucleotide, primary construct, and mmRNA of the invention can be transfected ex vivo into cells, which are subsequently transplanted into a subject. As non-limiting examples, the pharmaceutical compositions may include red blood cells to deliver modified RNA to liver and myeloid cells, virosomes to deliver modified RNA in virus-like particles (VLPs), and electroporated cells such as, but not limited to, from MAXCYTE® (Gaithersburg, Md.) and from ERYTECH® (Lyon, France) to deliver modified RNA. Examples of use of red blood cells, viral particles and electroporated cells to deliver payloads other than mmRNA have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108: 10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

The oncology-related polynucleotides, primary constructs and mmRNA may be delivered in synthetic VLPs synthesized by the methods described in International Pub No. WO2011085231 and US Pub No. 20110171248, each of which are herein incorporated by reference in their entireties.

Cell-based formulations of the oncology-related polynucleotide, primary construct, and mmRNA of the invention may be used to ensure cell transfection (e.g., in the cellular carrier), alter the biodistribution of the oncology-related polynucleotide, primary construct, or mmRNA (e.g., by targeting the cell carrier to specific tissues or cell types), and/or increase the translation of encoded protein.

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of the cell plasma membrane. Sonoporation methods are known to those in the art and are used to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; all herein incorporated by reference in their entirety). Sonoporation methods are known in the art and are also taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art and are used to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). In one embodiment, polynucleotides, primary constructs or mmRNA may be delivered by electroporation as described in Example 8.

Hyaluronidase

The intramuscular or subcutaneous localized injection of polynucleotide, primary construct, or mmRNA of the invention can include hyaluronidase, which catalyzes the hydrolysis of hyaluronan. By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440; herein incorporated by reference in its entirety). It is useful to speed their dispersion and systemic distribution of encoded proteins produced by transfected cells. Alternatively, the hyaluronidase can be used to increase the number of cells exposed to a oncology-related polynucleotide, primary construct, or mmRNA of the invention administered intramuscularly or subcutaneously.

Nanoparticle Mimics

The oncology-related polynucleotide, primary construct or mmRNA of the invention may be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the oncology-related polynucleotide, primary construct or mmRNA of the invention may be encapsulated in a non-viron particle which can mimic the delivery function of a virus (see International Pub. No. WO2012006376 herein incorporated by reference in its entirety).

Nanotubes

The oncology-related polynucleotides, primary constructs or mmRNA of the invention can be attached or otherwise bound to at least one nanotube such as, but not limited to, rosette nanotubes, rosette nanotubes having twin bases with a linker, carbon nanotubes and/or single-walled carbon nanotubes, The oncology-related polynucleotides, primary constructs or mmRNA may be bound to the nanotubes through forces such as, but not limited to, steric, ionic, covalent and/or other forces.

In one embodiment, the nanotube can release one or more polynucleotides, primary constructs or mmRNA into cells. The size and/or the surface structure of at least one nanotube may be altered so as to govern the interaction of the nanotubes within the body and/or to attach or bind to the oncology-related polynucleotides, primary constructs or mmRNA disclosed herein. In one embodiment, the building block and/or the functional groups attached to the building block of the at least one nanotube may be altered to adjust the dimensions and/or properties of the nanotube. As a non-limiting example, the length of the nanotubes may be altered to hinder the nanotubes from passing through the holes in the walls of normal blood vessels but still small enough to pass through the larger holes in the blood vessels of tumor tissue.

In one embodiment, at least one nanotube may also be coated with delivery enhancing compounds including polymers, such as, but not limited to, polyethylene glycol. In another embodiment, at least one nanotube and/or the oncology-related polynucleotides, primary constructs or mmRNA may be mixed with pharmaceutically acceptable excipients and/or delivery vehicles.

In one embodiment, the oncology-related polynucleotides, primary constructs or mmRNA are attached and/or otherwise bound to at least one rosette nanotube. The rosette nanotubes may be formed by a process known in the art and/or by the process described in International Publication No. WO2012094304, herein incorporated by reference in its entirety. At least one polynucleotide, primary construct and/or mmRNA may be attached and/or otherwise bound to at least one rosette nanotube by a process as described in International Publication No. WO2012094304, herein incorporated by reference in its entirety, where rosette nanotubes or modules forming rosette nanotubes are mixed in aqueous media with at least one polynucleotide, primary construct and/or mmRNA under conditions which may cause at least one polynucleotide, primary construct or mmRNA to attach or otherwise bind to the rosette nanotubes.

In one embodiment, the oncology-related polynucleotides, primary constructs or mmRNA may be attached to and/or otherwise bound to at least one carbon nanotube. As a non-limiting example, the oncology-related polynucleotides, primary constructs or mmRNA may be bound to a linking agent and the linked agent may be bound to the carbon nanotube (See e.g., U.S. Pat. No. 8,246,995; herein incorporated by reference in its entirety). The carbon nanotube may be a single-walled nanotube (See e.g., U.S. Pat. No. 8,246,995; herein incorporated by reference in its entirety).

Conjugates

The polynucleotides, primary constructs, and mmRNA of the invention include conjugates, such as a oncology-related polynucleotide, primary construct, or mmRNA covalently linked to a carrier or targeting group, or including two encoding regions that together produce a fusion protein (e.g., bearing a targeting group and therapeutic protein or peptide).

The conjugates of the invention include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Representative U.S. patents that teach the preparation of polynucleotide conjugates, particularly to RNA, include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference in their entireties.

In one embodiment, the conjugate of the present invention may function as a carrier for the modified nucleic acids and mmRNA of the present invention. The conjugate may comprise a cationic polymer such as, but not limited to, polyamine, polylysine, polyalkylenimine, and polyethylenimine which may be grafted to with poly(ethylene glycol). As a non-limiting example, the conjugate may be similar to the polymeric conjugate and the method of synthesizing the polymeric conjugate described in U.S. Pat. No. 6,586,524 herein incorporated by reference in its entirety.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

In one embodiment, pharmaceutical compositions of the present invention may include chemical modifications such as, but not limited to, modifications similar to locked nucleic acids.

Representative U.S. patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include polynucleotides, primary constructs or mmRNA with phosphorothioate backbones and oligonucleosides with other modified backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucleotides featured herein have morpholino backbone structures of the above-referenced U.S. Pat. No. 5,034,506.

Modifications at the 2' position may also aid in delivery. Preferably, modifications at the 2' position are not located in a polypeptide-coding sequence, i.e., not in a translatable region. Modifications at the 2' position may be located in a 5'UTR, a 3'UTR and/or a tailing region. Modifications at the 2' position can include one of the following at the 2' position: H (i.e., 2'-deoxy); F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$-$_n$O$CH_3$, O($CH_2$)$_n$NH$_2$, O($CH_2$)$_n$$CH_3$, O($CH_2$)$_n$ONH$_2$, and O($CH_2$)$_n$ON[($CH_2$)$_n$$CH_3$)]$_2$, where n and m are from 1 to about 10. In other embodiments, the oncology-related polynucleotides, primary constructs or mmRNA include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O(CH$_2$)$_2$ON (CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_3$)$_2$, also described in examples herein below. Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions, particularly the 3' position of the sugar on the 3' terminal nucleotide or in 2'-5' linked dsRNAs and the 5' position of 5' terminal nucleotide. Polynucleotides of the invention may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920 and each of which is herein incorporated by reference.

In still other embodiments, the oncology-related polynucleotide, primary construct, or mmRNA is covalently conjugated to a cell penetrating polypeptide. The cell-penetrating peptide may also include a signal sequence. The conjugates of the invention can be designed to have increased stability; increased cell transfection; and/or altered the biodistribution (e.g., targeted to specific tissues or cell types).

In one embodiment, the polynucleotides, primary constructs or mmRNA may be conjugated to an agent to enhance delivery. As a non-limiting example, the agent may be a monomer or polymer such as a targeting monomer or a polymer having targeting blocks as described in International Publication No. WO2011062965, herein incorporated by reference in its entirety. In another non-limiting example, the agent may be a transport agent covalently coupled to the polynucleotides, primary constructs or mmRNA of the present invention (See e.g., U.S. Pat. Nos. 6,835,393 and 7,374,778, each of which is herein incorporated by reference in its entirety). In yet another non-limiting example, the agent may be a membrane barrier transport enhancing agent such as those described in U.S. Pat. Nos. 7,737,108 and 8,003,129, each of which is herein incorporated by reference in its entirety.

In another embodiment, polynucleotides, primary constructs or mmRNA may be conjugated to SMARTT POLYMER TECHNOLOGY® (PHASERX®, Inc. Seattle, Wash.).

Self-Assembled Nanoparticles

Nucleic Acid Self-Assembled Nanoparticles

Self-assembled nanoparticles have a well-defined size which may be precisely controlled as the nucleic acid strands may be easily reprogrammable. For example, the optimal particle size for a cancer-targeting nanodelivery carrier is 20-100 nm as a diameter greater than 20 nm avoids renal clearance and enhances delivery to certain tumors through enhanced permeability and retention effect. Using self-assembled nucleic acid nanoparticles a single uniform population in size and shape having a precisely controlled spatial orientation and density of cancer-targeting ligands for enhanced delivery. As a non-limiting example, oligonucleotide nanoparticles were prepared using programmable self-assembly of short DNA fragments and therapeutic siRNAs. These nanoparticles are molecularly identical with controllable particle size and target ligand location and density. The DNA fragments and siRNAs self-assembled into a one-step reaction to generate DNA/siRNA tetrahedral nanoparticles for targeted in vivo delivery. (Lee et al., Nature Nanotechnology 2012 7:389-393; herein incorporated by reference in its entirety).

In one embodiment, the oncology-related polynucleotides, primary constructs and/or mmRNA disclosed herein may be formulated as self-assembled nanoparticles. As a non-limiting example, nucleic acids may be used to make nanoparticles which may be used in a delivery system for the oncology-related polynucleotides, primary constructs and/or mmRNA of the present invention (See e.g., International Pub. No. WO2012125987; herein incorporated by reference in its entirety).

In one embodiment, the nucleic acid self-assembled nanoparticles may comprise a core of the oncology-related polynucleotides, primary constructs or mmRNA disclosed herein and a polymer shell. The polymer shell may be any of the polymers described herein and are known in the art. In an additional embodiment, the polymer shell may be used to protect the polynucleotides, primary constructs and mmRNA in the core.

Polymer-Based Self-Assembled Nanoparticles

Polymers may be used to form sheets which self-assembled into nanoparticles. These nanoparticles may be used to deliver the oncology-related polynucleotides, primary constructs and mmRNA of the present invention. In one embodiment, these self-assembled nanoparticles may be microsponges formed of long polymers of RNA hairpins which form into crystalline 'pleated' sheets before self-assembling into microsponges. These microsponges are densely-packed sponge like microparticles which may function as an efficient carrier and may be able to deliver cargo to a cell. The microsponges may be from 1 um to 300 nm in diameter. The microsponges may be complexed with other agents known in the art to form larger microsponges. As a non-limiting example, the microsponge may be complexed with an agent to form an outer layer to promote cellular uptake such as polycation polyethyleneime (PEI). This complex can form a 250-nm diameter particle that can remain stable at high temperatures (150° C.) (Grabow and Jaegar, Nature Materials 2012, 11:269-269; herein incorporated by reference in its entirety). Additionally these microsponges may be able to exhibit an extraordinary degree of protection from degradation by ribonucleases.

In another embodiment, the polymer-based self-assembled nanoparticles such as, but not limited to, microsponges, may be fully programmable nanoparticles. The geometry, size and stoichiometry of the nanoparticle may be precisely controlled to create the optimal nanoparticle for delivery of cargo such as, but not limited to, polynucleotides, primary constructs and/or mmRNA.

In one embodiment, the polymer based nanoparticles may comprise a core of the oncology-related polynucleotides, primary constructs and/or mmRNA disclosed herein and a polymer shell. The polymer shell may be any of the polymers described herein and are known in the art. In an additional embodiment, the polymer shell may be used to protect the polynucleotides, primary construct and/or mmRNA in the core.

In yet another embodiment, the polymer based nanoparticle may comprise a non-nucleic acid polymer comprising a plurality of heterogenous monomers such as those described in International Publication No. WO2013009736, herein incorporated by reference in its entirety.

Inorganic Nanoparticles

The oncology-related polynucleotides, primary constructs and/or mmRNAs of the present invention may be formulated in inorganic nanoparticles (U.S. Pat. No. 8,257,745, herein incorporated by reference in its entirety). The inorganic nanoparticles may include, but are not limited to, clay substances that are water swellable. As a non-limiting example, the inorganic nanoparticle may include synthetic smectite clays which are made from simple silicates (See e.g., U.S. Pat. Nos. 5,585,108 and 8,257,745 each of which are herein incorporated by reference in their entirety).

In one embodiment, the inorganic nanoparticles may comprise a core of the modified nucleic acids disclosed herein and a polymer shell. The polymer shell may be any of the polymers described herein and are known in the art. In an additional embodiment, the polymer shell may be used to protect the modified nucleic acids in the core.

Semi-Conductive and Metallic Nanoparticles

The oncology-related polynucleotides, primary constructs and/or mmRNAs of the present invention may be formulated in water-dispersible nanoparticle comprising a semiconductive or metallic material (U.S. Pub. No. 20120228565; herein incorporated by reference in its entirety) or formed in a magnetic nanoparticle (U.S. Pub. No. 20120265001 and 20120283503; each of which is herein incorporated by reference in its entirety). The water-dispersible nanoparticles may be hydrophobic nanoparticles or hydrophilic nanoparticles.

In one embodiment, the semi-conductive and/or metallic nanoparticles may comprise a core of the oncology-related polynucleotides, primary constructs and/or mmRNA disclosed herein and a polymer shell. The polymer shell may be any of the polymers described herein and are known in the art. In an additional embodiment, the polymer shell may be used to protect the oncology-related polynucleotides, primary constructs and/or mmRNA in the core.

Gels and Hydrogels

In one embodiment, the oncology-related polynucleotides, primary constructs and/or mmRNA disclosed herein may be encapsulated into any hydrogel known in the art which may form a gel when injected into a subject. Hydrogels are a network of polymer chains that are hydrophilic, and are sometimes found as a colloidal gel in which water is the dispersion medium. Hydrogels are highly absorbent (they can contain over 99% water) natural or synthetic polymers. Hydrogels also possess a degree of flexibility very similar to natural tissue, due to their significant water content. The hydrogel described herein may used to encapsulate lipid nanoparticles which are biocompatible, biodegradable and/or porous.

As a non-limiting example, the hydrogel may be an aptamer-functionalized hydrogel. The aptamer-functionalized hydrogel may be programmed to release one or more polynucleotides, primary constructs and/or mmRNA using nucleic acid hybridization. (Battig et al., J. Am. Chem. Society. 2012 134:12410-12413; herein incorporated by reference in its entirety).

As another non-limiting example, the hydrogel may be a shaped as an inverted opal.

The opal hydrogels exhibit higher swelling ratios and the swelling kinetics is an order of magnitude faster as well. Methods of producing opal hydrogels and description of opal hydrogels are described in International Pub. No. WO2012148684, herein incorporated by reference in its entirety.

In yet another non-limiting example, the hydrogel may be an antibacterial hydrogel. The antibacterial hydrogel may comprise a pharmaceutical acceptable salt or organic material such as, but not limited to pharmaceutical grade and/or medical grade silver salt and aloe vera gel or extract. (International Pub. No. WO2012151438, herein incorporated by reference in its entirety).

In one embodiment, the modified mRNA may be encapsulated in a lipid nanoparticle and then the lipid nanoparticle may be encapsulated into a hyrdogel.

In one embodiment, the oncology-related polynucleotides, primary constructs and/or mmRNA disclosed herein may be encapsulated into any gel known in the art. As a non-limiting example the gel may be a fluorouracil injectable gel or a fluorouracil injectable gel containing a chemical compound and/or drug known in the art. As another example, the oncology-related polynucleotides, primary constructs and/or mmRNA may be encapsulated in a fluorouracil gel containing epinephrine (See e.g., Smith et al. Cancer Chemotherapy and Pharmacology, 1999 44(4):267-274; herein incorporated by reference in its entirety).

In one embodiment, the oncology-related polynucleotides, primary constructs and/or mmRNA disclosed herein may be encapsulated into a fibrin gel, fibrin hydrogel or fibrin glue. In another embodiment, the oncology-related polynucleotides, primary constructs and/or mmRNA may be formulated in a lipid nanoparticle or a rapidly eliminated lipid nanoparticle prior to being encapsulated into a fibrin gel, fibrin hydrogel or a fibrin glue. In yet another embodiment, the oncology-related polynucleotides, primary constructs and/or mmRNA may be formulated as a lipoplex prior to being encapsulated into a fibrin gel, hydrogel or a fibrin glue. Fibrin gels, hydrogels and glues comprise two components, a fibrinogen solution and a thrombin solution which is rich in calcium (See e.g., Spicer and Mikos, Journal of Controlled Release 2010. 148: 49-55; Kidd et al. Journal of Controlled Release 2012. 157:80-85; each of which is herein incorporated by reference in its entirety). The concentration of the components of the fibrin gel, hydrogel and/or glue can be altered to change the characteristics, the network mesh size, and/or the degradation characteristics of the gel, hydrogel and/or glue such as, but not limited to changing the release characteristics of the fibrin gel, hydrogel and/or glue. (See e.g., Spicer and Mikos, Journal of Controlled Release 2010. 148: 49-55; Kidd et al. Journal of Controlled Release 2012. 157:80-85; Catelas et al. Tissue Engineering 2008. 14:119-128; each of which is herein incorporated by reference in its entirety). This feature may be advantageous when used to deliver the modified mRNA disclosed herein. (See e.g., Kidd et al. Journal of Controlled Release 2012. 157:80-85; Catelas et al. Tissue Engineering 2008. 14:119-128; each of which is herein incorporated by reference in its entirety).

Cations and Anions

Formulations of polynucleotides, primary constructs and/or mmRNA disclosed herein may include cations or anions. In one embodiment, the formulations include metal cations such as, but not limited to, Zn2+, Ca2+, Cu2+, Mg+ and combinations thereof. As a non-limiting example, formulations may include polymers and a polynucleotides, primary constructs and/or mmRNA complexed with a metal cation (See e.g., U.S. Pat. Nos. 6,265,389 and 6,555,525, each of which is herein incorporated by reference in its entirety).

Molded Nanoparticles and Microparticles

The oncology-related polynucleotides, primary constructs and/or mmRNA disclosed herein may be formulated in nanoparticles and/or microparticles. These nanoparticles and/or microparticles may be molded into any size shape and chemistry. As an example, the nanoparticles and/or microparticles may be made using the PRINT® technology by LIQUIDA TECHNOLOGIES® (Morrisville, N.C.) (See e.g., International Pub. No. WO2007024323; herein incorporated by reference in its entirety).

In one embodiment, the molded nanoparticles may comprise a core of the oncology-related polynucleotides, primary constructs and/or mmRNA disclosed herein and a polymer shell. The polymer shell may be any of the polymers described herein and are known in the art. In an additional embodiment, the polymer shell may be used to protect the polynucleotides, primary construct and/or mmRNA in the core.

NanoJackets and NanoLiposomes

The oncology-related polynucleotides, primary constructs and/or mmRNA disclosed herein may be formulated in NanoJackets and NanoLiposomes by Keystone Nano (State College, Pa.). NanoJackets are made of compounds that are naturally found in the body including calcium, phosphate and may also include a small amount of silicates. Nanojackets may range in size from 5 to 50 nm and may be used to deliver hydrophilic and hydrophobic compounds such as, but not limited to, polynucleotides, primary constructs and/or mmRNA.

NanoLiposomes are made of lipids such as, but not limited to, lipids which naturally occur in the body. NanoLiposomes may range in size from 60-80 nm and may be used to deliver hydrophilic and hydrophobic compounds such as, but not limited to, polynucleotides, primary constructs and/or mmRNA. In one aspect, the oncology-related polynucleotides, primary constructs and/or mmRNA disclosed herein are formulated in a NanoLiposome such as, but not limited to, Ceramide NanoLiposomes.

Excipients

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's *The Science and Practice of Pharmacy*, $21^{st}$ Edition, A. R. Gennaro (Lippincott, Williams & Wilkins, Baltimore, Md., 2006; incorporated herein by reference in its entirety) discloses various excipients used in formulating pharmaceutical compositions and known techniques for the preparation thereof. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

In some embodiments, a pharmaceutically acceptable excipient is at least 95%, at least 96%, at least 97%, at least 98%, at least 99%, or 100% pure. In some embodiments, an excipient is approved for use in humans and for veterinary use. In some embodiments, an excipient is approved by United States Food and Drug Administration. In some embodiments, an excipient is pharmaceutical grade. In some embodiments, an excipient meets the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical compositions.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEENn®60], polyoxyethylene sorbitan monooleate [TWEEN®80], sorbitan monopalmitate [SPAN®40], sorbitan monostearate [SPAN®60], sorbitan tristearate [SPAN®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly(vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (Veegum®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Exemplary antioxidants include, but are not limited to, alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE™, KATHON™, and/or EUXYL®.

Exemplary buffering agents include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Delivery

The present disclosure encompasses the delivery of oncology-related polynucleotides, primary constructs or mmRNA for any of therapeutic, pharmaceutical, diagnostic or imaging by any appropriate route taking into consideration likely advances in the sciences of drug delivery. Delivery may be naked or formulated.

Naked Delivery

The oncology-related polynucleotides, primary constructs or mmRNA of the present invention may be delivered to a cell naked. As used herein in, "naked" refers to delivering polynucleotides, primary constructs or mmRNA free from agents which promote transfection. For example, the oncology-related polynucleotides, primary constructs or mmRNA delivered to the cell may contain no modifications. The naked polynucleotides, primary constructs or mmRNA may be delivered to the cell using routes of administration known in the art and described herein.

Formulated Delivery

The oncology-related polynucleotides, primary constructs or mmRNA of the present invention may be formulated, using the methods described herein. The formulations may contain polynucleotides, primary constructs or mmRNA which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated polynucleotides, primary constructs or mmRNA may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

Administration

The oncology-related polynucleotides, primary constructs or mmRNA of the present invention may be administered by any route which results in a therapeutically effective outcome. These include, but are not limited to enteral, gastroenteral, epidural, oral, transdermal, epidural (peridural), intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection, (into the base of the penis), intravaginal administration, intrauterine, extra-amniotic administration, transdermal (diffusion through the intact skin for systemic distribution), transmucosal (diffusion through a mucous membrane), insufflation (snorting), sublingual, sublabial, enema, eye drops (onto the conjunctiva), or in ear drops. In specific embodiments, compositions may be administered in a way which allows them cross the blood-brain barrier, vascular barrier, or other epithelial barrier. Non-limiting routes of administration for the oncology-related polynucleotides, primary constructs or mmRNA of the present invention are described below.

Parenteral and Injectable Administration

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Rectal and Vaginal Administration

Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Oral Administration

Liquid dosage forms for oral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, compositions containing the oncology-related polynucleotides, primary constructs or mmRNA of the invention may be formulated for administration topically. The skin may be an ideal target site for delivery as it is readily accessible. Gene expression may be restricted not only to the skin, potentially avoiding nonspecific toxicity, but also to specific layers and cell types within the skin.

The site of cutaneous expression of the delivered compositions will depend on the route of nucleic acid delivery. Three routes are commonly considered to deliver polynucleotides, primary constructs or mmRNA to the skin: (i) topical application (e.g. for local/regional treatment and/or oncology-related applications); (ii) intradermal injection (e.g. for local/regional treatment and/or oncology-related applications); and (iii) systemic delivery (e.g. for treatment of dermatologic diseases that affect both cutaneous and extracutaneous regions). Polynucleotides, primary constructs or mmRNA can be delivered to the skin by several different approaches known in the art. Most topical delivery approaches have been shown to work for delivery of DNA, such as but not limited to, topical application of non-cationic liposome-DNA complex, cationic liposome-DNA complex, particle-mediated (gene gun), puncture-mediated gene transfections, and viral delivery approaches. After delivery of the nucleic acid, gene products have been detected in a number of different skin cell types, including, but not limited to, basal keratinocytes, sebaceous gland cells, dermal fibroblasts and dermal macrophages.

In one embodiment, the invention provides for a variety of dressings (e.g., wound dressings) or bandages (e.g., adhesive bandages) for conveniently and/or effectively carrying out methods of the present invention. Typically dressing or bandages may comprise sufficient amounts of pharmaceutical compositions and/or polynucleotides, primary constructs or mmRNA described herein to allow a user to perform multiple treatments of a subject(s).

In one embodiment, the invention provides for the oncology-related polynucleotides, primary constructs or mmRNA compositions to be delivered in more than one injection.

In one embodiment, before topical and/or transdermal administration at least one area of tissue, such as skin, may be subjected to a device and/or solution which may increase permeability. In one embodiment, the tissue may be subjected to an abrasion device to increase the permeability of the skin (see U.S. Patent Publication No. 20080275468, herein incorporated by reference in its entirety). In another embodiment, the tissue may be subjected to an ultrasound enhancement device. An ultrasound enhancement device may include, but is not limited to, the devices described in U.S. Publication No. 20040236268 and U.S. Pat. Nos. 6,491,657 and 6,234,990; each of which are herein incorporated by reference in their entireties. Methods of enhancing the permeability of tissue are described in U.S. Publication Nos. 20040171980 and 20040236268 and U.S. Pat. No. 6,190,315; each of which are herein incorporated by reference in their entireties.

In one embodiment, a device may be used to increase permeability of tissue before delivering formulations of modified mRNA described herein. The permeability of skin may be measured by methods known in the art and/or described in U.S. Pat. No. 6,190,315, herein incorporated by reference in its entirety. As a non-limiting example, a modified mRNA formulation may be delivered by the drug delivery methods described in U.S. Pat. No. 6,190,315, herein incorporated by reference in its entirety.

In another non-limiting example tissue may be treated with a eutectic mixture of local anesthetics (EMLA) cream before, during and/or after the tissue may be subjected to a device which may increase permeability. Katz et al. (Anesth Analg (2004); 98:371-76; herein incorporated by reference in its entirety) showed that using the EMLA cream in combination with a low energy, an onset of superficial cutaneous analgesia was seen as fast as 5 minutes after a pretreatment with a low energy ultrasound.

In one embodiment, enhancers may be applied to the tissue before, during, and/or after the tissue has been treated to increase permeability. Enhancers include, but are not limited to, transport enhancers, physical enhancers, and cavitation enhancers. Non-limiting examples of enhancers are described in U.S. Pat. No. 6,190,315, herein incorporated by reference in its entirety.

In one embodiment, a device may be used to increase permeability of tissue before delivering formulations of modified mRNA described herein, which may further contain a substance that invokes an immune response. In another non-limiting example, a formulation containing a substance to invoke an immune response may be delivered by the methods described in U.S. Publication Nos. 20040171980 and 20040236268; each of which are herein incorporated by reference in their entireties.

Dosage forms for topical and/or transdermal administration of a composition may include ointments, pastes, creams, lotions, gels, powders, solutions, sprays, inhalants and/or patches. Generally, an active ingredient is admixed under sterile conditions with a pharmaceutically acceptable excipient and/or any needed preservatives and/or buffers as may be required. Additionally, the present invention contemplates the use of transdermal patches, which often have the added advantage of providing controlled delivery of a compound to the body. Such dosage forms may be prepared, for example, by dissolving and/or dispensing the compound in the proper medium. Alternatively or additionally, rate may be controlled by either providing a rate controlling membrane and/or by dispersing the compound in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 0.1% to about 10% (w/w) active ingredient, although the concentration of active ingredient may be as high as the solubility limit of the active ingredient in the solvent. Formulations for topical administration may further comprise one or more of the additional ingredients described herein.

Depot Administration

As described herein, in some embodiments, the composition is formulated in depots for extended release. Generally, a specific organ or tissue (a "target tissue") is targeted for administration.

In some aspects of the invention, the oncology-related polynucleotides, primary constructs or mmRNA are spatially retained within or proximal to a target tissue. Provided are method of providing a composition to a target tissue of a mammalian subject by contacting the target tissue (which contains one or more target cells) with the composition under conditions such that the composition, in particular the nucleic acid component(s) of the composition, is substantially retained in the target tissue, meaning that at least 10, 20, 30, 40, 50, 60, 70, 80, 85, 90, 95, 96, 97, 98, 99, 99.9, 99.99 or greater than 99.99% of the composition is retained in the target tissue. Advantageously, retention is determined by measuring the amount of the nucleic acid present in the composition that enters one or more target cells. For example, at least 1, 5, 10, 20, 30, 40, 50, 60, 70, 80, 85, 90, 95, 96, 97, 98, 99, 99.9, 99.99 or greater than 99.99% of the nucleic acids administered to the subject are present intracellularly at a period of time following administration. For example, intramuscular injection to a mammalian subject is performed using an aqueous composition containing a ribonucleic acid and a transfection reagent, and retention of the composition is determined by measuring the amount of the ribonucleic acid present in the muscle cells.

Aspects of the invention are directed to methods of providing a composition to a target tissue of a mammalian subject, by contacting the target tissue (containing one or more target cells) with the composition under conditions such that the composition is substantially retained in the target tissue. The composition contains an effective amount of a polynucleotides, primary constructs or mmRNA such that the polypeptide of interest is produced in at least one target cell. The compositions generally contain a cell penetration agent, although "naked" nucleic acid (such as nucleic acids without a cell penetration agent or other agent) is also contemplated, and a pharmaceutically acceptable carrier.

In some circumstances, the amount of a protein produced by cells in a tissue is desirably increased. Preferably, this increase in protein production is spatially restricted to cells within the target tissue. Thus, provided are methods of increasing production of a protein of interest in a tissue of a mammalian subject. A composition is provided that contains polynucleotides, primary constructs or mmRNA characterized in that a unit quantity of composition has been determined to produce the polypeptide of interest in a substantial percentage of cells contained within a predetermined volume of the target tissue.

In some embodiments, the composition includes a plurality of different polynucleotides, primary constructs or mmRNA, where one or more than one of the oncology-related polynucleotides, primary constructs or mmRNA encodes a polypeptide of interest. Optionally, the composition also contains a cell penetration agent to assist in the intracellular delivery of the composition. A determination is made of the dose of the composition required to produce the polypeptide of interest in a substantial percentage of cells contained within the predetermined volume of the target tissue (generally, without inducing significant production of the polypeptide of interest in tissue adjacent to the predetermined volume, or distally to the target tissue). Subsequent to this determination, the determined dose is introduced directly into the tissue of the mammalian subject.

In one embodiment, the invention provides for the oncology-related polynucleotides, primary constructs or mmRNA to be delivered in more than one injection or by split dose injections.

In one embodiment, the invention may be retained near target tissue using a small disposable drug reservoir, patch pump or osmotic pump. Non-limiting examples of patch pumps include those manufactured and/or sold by BD® (Franklin Lakes, N.J.), Insulet Corporation (Bedford, Mass.), SteadyMed Therapeutics (San Francisco, Calif.), Medtronic (Minneapolis, Minn.) (e.g., MiniMed), UniLife (York, Pa.), Valeritas (Bridgewater, N.J.), and SpringLeaf Therapeutics (Boston, Mass.). A non-limiting example of an osmotic pump include those manufactured by DURECT® (Cupertino, Calif.) (e.g., DUROS® and ALZET®).

Pulmonary Administration

A pharmaceutical composition may be prepared, packaged, and/or sold in a formulation suitable for pulmonary administration via the buccal cavity. Such a formulation may comprise dry particles which comprise the active ingredient and which have a diameter in the range from about 0.5 nm to about 7 nm or from about 1 nm to about 6 nm. Such compositions are suitably in the form of dry powders for administration using a device comprising a dry powder reservoir to which a stream of propellant may be directed to disperse the powder and/or using a self propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nm and at least 95% of the particles by number have a diameter less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally the propellant may constitute 50% to 99.9% (w/w) of the composition, and active ingredient may constitute 0.1% to 20% (w/w) of the composition. A propellant may further comprise additional ingredients such as a liquid non-ionic and/or solid anionic surfactant and/or a solid diluent (which may have a particle size of the same order as particles comprising the active ingredient).

As a non-limiting example, the oncology-related polynucleotides, primary constructs and/or mmRNA described herein may be formulated for pulmonary delivery by the methods described in U.S. Pat. No. 8,257,685; herein incorporated by reference in its entirety.

Pharmaceutical compositions formulated for pulmonary delivery may provide an active ingredient in the form of droplets of a solution and/or suspension. Such formulations may be prepared, packaged, and/or sold as aqueous and/or dilute alcoholic solutions and/or suspensions, optionally sterile, comprising active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Intranasal, Nasal and Buccal Administration

Formulations described herein as being useful for pulmonary delivery are useful for intranasal delivery of a pharmaceutical composition. Another formulation suitable for intranasal administration is a coarse powder comprising the active ingredient and having an average particle from about 0.2 μm to 500 μm. Such a formulation is administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

Ophthalmic Administration

A pharmaceutical composition may be prepared, packaged, and/or sold in a formulation suitable for ophthalmic administration. Such formulations may, for example, be in the form of eye drops including, for example, a 0.1/1.0% (w/w) solution and/or suspension of the active ingredient in an aqueous or oily liquid excipient. Such drops may further comprise buffering agents, salts, and/or one or more other of any additional ingredients described herein. Other ophthalmically-administrable formulations which are useful include those which comprise the active ingredient in microcrystalline form and/or in a liposomal preparation. Ear drops and/or eye drops are contemplated as being within the scope of this invention. A multilayer thin film device may be prepared to contain a pharmaceutical composition for delivery to the eye and/or surrounding tissue.

Payload Administration Detectable Agents and Therapeutic Agents

The oncology-related polynucleotides, primary constructs or mmRNA described herein can be used in a number of different scenarios in which delivery of a substance (the "payload") to a biological target is desired, for example delivery of detectable substances for detection of the target, or delivery of a therapeutic agent. Detection methods can include, but are not limited to, both imaging in vitro and in vivo imaging methods, e.g., immunohistochemistry, bioluminescence imaging (BLI), Magnetic Resonance Imaging (MRI), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

The oncology-related polynucleotides, primary constructs or mmRNA can be designed to include both a linker and a payload in any useful orientation. For example, a linker having two ends is used to attach one end to the payload and the other end to the nucleobase, such as at the C-7 or C-8 positions of the deaza-adenosine or deaza-guanosine or to the N-3 or C-5 positions of cytosine or uracil. The polynucleotide of the invention can include more than one payload (e.g., a label and a transcription inhibitor), as well as a cleavable linker. In one embodiment, the modified nucleotide is a modified 7-deaza-adenosine triphosphate, where one end of a cleavable linker is attached to the C7 position of 7-deaza-adenine, the other end of the linker is attached to an inhibitor (e.g., to the C5 position of the nucleobase on a cytidine), and a label (e.g., Cy5) is attached to the center of the linker (see, e.g., compound 1 of A*pCp C5 Parg Capless in FIG. 5 and columns 9 and 10 of U.S. Pat. No. 7,994,304, incorporated herein by reference). Upon incorporation of the modified 7-deaza-adenosine triphosphate to an encoding region, the resulting polynucleotide having a cleavable linker attached to a label and an inhibitor (e.g., a polymerase inhibitor). Upon cleavage of the linker (e.g., with reductive conditions to reduce a linker having a cleavable disulfide moiety), the label and inhibitor are released. Additional linkers and payloads (e.g., therapeutic agents, detectable labels, and cell penetrating payloads) are described herein.

Scheme 12 below depicts an exemplary modified nucleotide wherein the nucleobase, adenine, is attached to a linker at the C-7 carbon of 7-deaza adenine. In addition, Scheme 12 depicts the modified nucleotide with the linker and payload, e.g., a detectable agent, incorporated onto the 3' end of the mRNA. Disulfide cleavage and 1,2-addition of the thiol group onto the propargyl ester releases the detectable agent. The remaining structure (depicted, for example, as pApC5 Parg in Scheme 12) is the inhibitor. The rationale for the structure of the modified nucleotides is that the tethered inhibitor sterically interferes with the ability of the polymerase to incorporate a second base. Thus, it is critical that the tether be long enough to affect this function and that the inhibitor be in a stereochemical orientation that inhibits or prohibits second and follow on nucleotides into the growing polynucleotide strand.

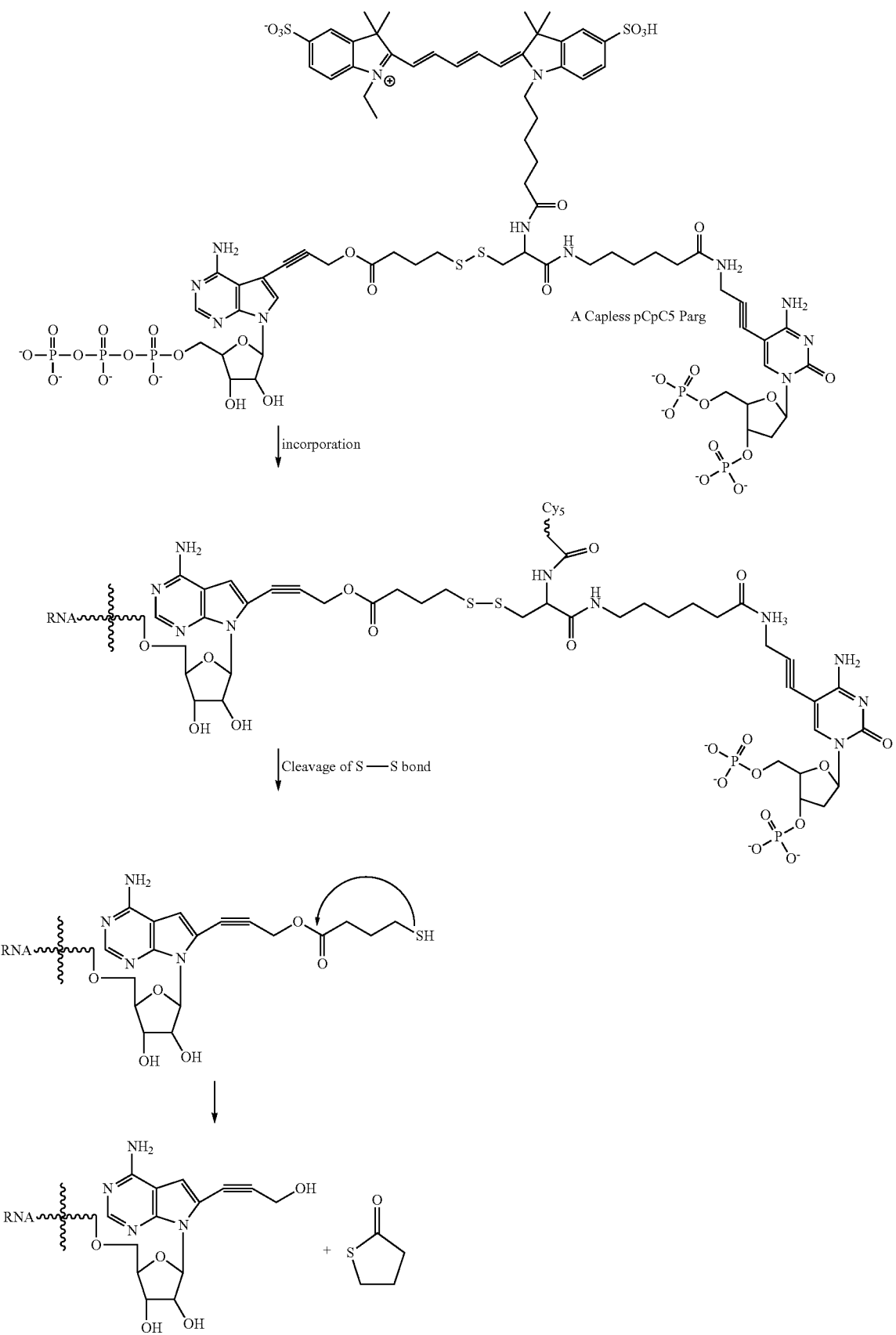
Scheme 12

For example, the oncology-related polynucleotides, primary constructs or mmRNA described herein can be used in reprogramming induced pluripotent stem cells (iPS cells), which can directly track cells that are transfected compared to total cells in the cluster. In another example, a drug that may be attached to the oncology-related polynucleotides, primary constructs or mmRNA via a linker and may be fluorescently labeled can be used to track the drug in vivo, e.g. intracellularly. Other examples include, but are not limited to, the use of a polynucleotides, primary constructs or mmRNA in reversible drug delivery into cells.

The oncology-related polynucleotides, primary constructs or mmRNA described herein can be used in intracellular targeting of a payload, e.g., detectable or therapeutic agent, to specific organelle. Exemplary intracellular targets can include, but are not limited to, the nuclear localization for advanced mRNA processing, or a nuclear localization sequence (NLS) linked to the mRNA containing an inhibitor.

In addition, the oncology-related polynucleotides, primary constructs or mmRNA described herein can be used to deliver therapeutic agents to cells or tissues, e.g., in living animals. For example, the oncology-related polynucleotides, primary constructs or mmRNA described herein can be used to deliver highly polar chemotherapeutics agents to kill cancer cells. The oncology-related polynucleotides, primary constructs or mmRNA attached to the therapeutic agent through a linker can facilitate member permeation allowing the therapeutic agent to travel into a cell to reach an intracellular target.

In one example, the linker is attached at the 2'-position of the ribose ring and/or at the 3' and/or 5' position of the polynucleotides, primary constructs mmRNA (See e.g., International Pub. No. WO2012030683, herein incorporated by reference in its entirety). The linker may be any linker disclosed herein, known in the art and/or disclosed in International Pub. No. WO2012030683, herein incorporated by reference in its entirety.

In another example, the oncology-related polynucleotides, primary constructs or mmRNA can be attached to the oncology-related polynucleotides, primary constructs or mmRNA a viral inhibitory peptide (VIP) through a cleavable linker. The cleavable linker can release the VIP and dye into the cell. In another example, the oncology-related polynucleotides, primary constructs or mmRNA can be attached through the linker to an ADP-ribosylate, which is responsible for the actions of some bacterial toxins, such as cholera toxin, diphtheria toxin, and pertussis toxin. These toxin proteins are ADP-ribosyltransferases that modify target proteins in human cells. For example, cholera toxin ADP-ribosylates G proteins modifies human cells by causing massive fluid secretion from the lining of the small intestine, which results in life-threatening diarrhea.

In some embodiments, the payload may be a therapeutic agent such as a cytotoxin, radioactive ion, chemotherapeutic, or other therapeutic agent. A cytotoxin or cytotoxic agent includes any agent that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein by its entirety), rachelmycin (CC-1065, see U.S. Pat. Nos. 5,475,092, 5,585,499, and 5,846,545, all of which are incorporated herein by reference), and analogs or homologs thereof. Radioactive ions include, but are not limited to iodine (e.g., iodine 125 or iodine 131), strontium 89, phosphorous, palladium, cesium, iridium, phosphate, cobalt, yttrium 90, samarium 153, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, the payload may be a detectable agent, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$Kr, $^{82}$Rb, $^{111}$In, $^{123}$I, $^{133}$Xe, $^{201}$Tl, $^{125}$I, $^{35}$S, $^{14}$C, $^{3}$H, or $^{99m}$Tc (e.g., as pertechnetate (technetate(VII), TcO$_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexyl), microbubbles, or perfluorocarbons). Such optically-detectable labels include for example, without limitation, 4-acetamido-4'-isothiocyanatostilbene-2,2' disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5' 5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine(1:1) (IR144); 5-chloro-2-[2-[3-[(5-chloro-3-ethyl-2(3H)-benzothiazolylidene)ethylidene]-2-(diphenylamino)-1-cyclopenten-1-yl]ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (CIBACRON™ Brilliant Red 3B-A); rhodamine and derivatives (e.g., 6-carboxy-X-rhodamine (ROX), 6-carboxyrhodamine (R6G), lissamine rhodamine B sulfonyl chloride rhodamine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable precursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

Combinations

The oncology-related polynucleotides, primary constructs or mmRNA may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body. As a non-limiting example, the nucleic acids or mmRNA may be used in combination with a pharmaceutical agent for the treatment of cancer or to control hyperproliferative cells. In U.S. Pat. No. 7,964,571, herein incorporated by reference in its entirety, a combination therapy for the treatment of solid primary or metastasized tumor is described using a pharmaceutical composition including a DNA plasmid encoding for interleukin-12 with a lipopolymer and also administering at least one anticancer agent or chemotherapeutic. Further, the nucleic acids and mmRNA of the present invention that encodes anti-proliferative molecules may be in a pharmaceutical composition with a lipopolymer (see e.g., U.S. Pub. No. 20110218231, herein incorporated by reference in its entirety, claiming a pharmaceutical composition comprising a DNA plasmid encoding an anti-proliferative molecule and a lipopolymer) which may be administered with at least one chemotherapeutic or anticancer agent.

It will further be appreciated that therapeutically, prophylactically, diagnostically, or imaging active agents utilized in combination may be administered together in a single composition or administered separately in different compositions. In general, it is expected that agents utilized in combination with be utilized at levels that do not exceed the levels at which they are utilized individually. In some embodiments, the levels utilized in combination will be lower than those utilized individually. In one embodiment, the combinations, each or together may be administered according to the split dosing regimens described herein.

Dosing

The present invention provides methods comprising administering modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect. The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used.

According to the present invention, it has been discovered that administration of mmRNA in split-dose regimens produce higher levels of proteins in mammalian subjects. As used herein, a "split dose" is the division of single unit dose or total daily dose into two or more doses, e.g, two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the mmRNA of the present invention are administered to a subject in split doses. The mmRNA may be formulated in buffer only or in a formulation described herein.

Dosage Forms

A pharmaceutical composition described herein can be formulated into a dosage form described herein, such as a topical, intranasal, intratracheal, or injectable (e.g., intravenous, intraocular, intravitreal, intramuscular, intracardiac, intraperitoneal, subcutaneous).

Liquid Dosage Forms

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions may be mixed with solubilizing agents such as CREMOPHOR®, alcohols, oils, modified oils, glycols, polysorbates, cyclodextrins, polymers, and/or combinations thereof.

Injectable

Injectable preparations, for example, sterile injectable aqueous or oleaginous suspensions may be formulated according to the known art and may include suitable dispersing agents, wetting agents, and/or suspending agents. Sterile injectable preparations may be sterile injectable solutions, suspensions, and/or emulsions in nontoxic parenterally acceptable diluents and/or solvents, for example, a solution in 1,3-butanediol. Among the acceptable vehicles and solvents that may be employed include, but are not limited to, water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it may be desirable to slow the absorption of the active ingredient from subcutaneous or intramuscular injection. This may be accomplished by the use of a liquid suspension of crystalline or amorphous material with poor water solubility. The rate of absorption of the polynucleotide, primary construct or mmRNA then depends upon its rate of dissolution which, in turn, may depend upon crystal size and crystalline form. Alternatively, delayed absorption of a parenterally administered polynucleotide, primary construct or mmRNA may be accomplished by dissolving or suspending the polynucleotide, primary construct or mmRNA in an oil vehicle. Injectable depot forms are made by forming microencapsule matrices of the polynucleotide, primary construct or mmRNA in biodegradable polymers such as polylactide-polyglycolide. Depending upon the ratio of polynucleotide, primary construct or mmRNA to polymer and the nature of the particular polymer employed, the rate of polynucleotide, primary construct or mmRNA release can be controlled. Examples of other biodegradable polymers include, but are not limited to, poly(orthoesters) and poly(anhydrides). Depot injectable formulations may be prepared by entrapping the polynucleotide, primary construct or mmRNA in liposomes or microemulsions which are compatible with body tissues.

Pulmonary

Formulations described herein as being useful for pulmonary delivery may also be used for intranasal delivery of a pharmaceutical composition. Another formulation suitable for intranasal administration may be a coarse powder comprising the active ingredient and having an average particle from about 0.2 μm to 500 μm. Such a formulation may be administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, contain about 0.1% to 20% (w/w) active ingredient, where the balance may comprise an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference in its entirety).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Properties of Pharmaceutical Compositions

The pharmaceutical compositions described herein can be characterized by one or more of bioavailability, therapeutic window and/or volume of distribution.

Bioavailability

The oncology-related polynucleotides, primary constructs or mmRNA, when formulated into a composition with a delivery agent as described herein, can exhibit an increase in bioavailability as compared to a composition lacking a delivery agent as described herein. As used herein, the term "bioavailability" refers to the systemic availability of a given amount of oncology-related polynucleotides, primary constructs or mmRNA administered to a mammal. Bioavailability can be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, herein incorporated by reference in its entirety.

The $C_{max}$ value is the maximum concentration of the compound achieved in the serum or plasma of a mammal following administration of the compound to the mammal. The $C_{max}$ value of a particular compound can be measured using methods known to those of ordinary skill in the art. The phrases "increasing bioavailability" or "improving the pharmacokinetics," as used herein mean that the systemic availability of a first polynucleotide, primary construct or mmRNA, measured as AUC, $C_{max}$, or $C_{min}$ in a mammal is greater, when co-administered with a delivery agent as described herein, than when such co-administration does not take place. In some embodiments, the bioavailability of the polynucleotide, primary construct or mmRNA can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Therapeutic Window

The oncology-related polynucleotides, primary constructs or mmRNA, when formulated into a composition with a delivery agent as described herein, can exhibit an increase in the therapeutic window of the administered polynucleotide, primary construct or mmRNA composition as compared to the therapeutic window of the administered polynucleotide, primary construct or mmRNA composition lacking a delivery agent as described herein. As used herein "therapeutic window" refers to the range of plasma concentrations, or the range of levels of therapeutically active substance at the site of action, with a high probability of eliciting a therapeutic effect. In some embodiments, the therapeutic window of the polynucleotide, primary construct or mmRNA when co-administered with a delivery agent as described herein can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Volume of Distribution

The oncology-related polynucleotides, primary constructs or mmRNA, when formulated into a composition with a delivery agent as described herein, can exhibit an improved volume of distribution ($V_{dist}$), e.g., reduced or targeted, relative to a composition lacking a delivery agent as described herein. The volume of distribution ($V_{dist}$) relates the amount of the drug in the body to the concentration of the drug in the blood or plasma. As used herein, the term "volume of distribution" refers to the fluid volume that would be required to contain the total amount of the drug in the body at the same concentration as in the blood or plasma: $V_{dist}$ equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, $V_{dist}$ can be used to determine a loading dose to achieve a steady state concentration. In some embodiments, the volume of distribution of the polynucleotide, primary construct or mmRNA when co-administered with a delivery agent as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the modified mRNA delivered to the animals may be categorized by analyzing the protein expression in the animals. The protein expression may be determined from analyzing a biological sample collected from a mammal administered the modified mRNA of the present invention. In one embodiment, the expression protein encoded by the modified mRNA administered to the mammal of at least 50 pg/ml may be preferred. For example, a protein expression of 50-200 pg/ml for the protein encoded by the modified mRNA delivered to the mammal may be seen as a therapeutically effective amount of protein in the mammal.

Detection of Modified Nucleic Acids by Mass Spectrometry

Mass spectrometry (MS) is an analytical technique that can provide structural and molecular mass/concentration information on molecules after their conversion to ions. The molecules are first ionized to acquire positive or negative charges and then they travel through the mass analyzer to arrive at different areas of the detector according to their mass/charge (m/z) ratio.

Mass spectrometry is performed using a mass spectrometer which includes an ion source for ionizing the fractionated sample and creating charged molecules for further analysis. For example ionization of the sample may be performed by electrospray ionization (ESI), atmospheric pressure chemical ionization (APCI), photoionization, electron ionization, fast atom bombardment (FAB)/liquid secondary ionization (LSIMS), matrix assisted laser desorption/ionization (MALDI), field ionization, field desorption, thermospray/plasmaspray ionization, and particle beam ionization. The skilled artisan will understand that the choice of ionization method can be determined based on the analyte to be measured, type of sample, the type of detector, the choice of positive versus negative mode, etc.

After the sample has been ionized, the positively charged or negatively charged ions thereby created may be analyzed to determine a mass-to-charge ratio (i.e., m/z). Suitable analyzers for determining mass-to-charge ratios include quadropole analyzers, ion traps analyzers, and time-of-flight analyzers. The ions may be detected using several detection modes. For example, selected ions may be detected (i.e., using a selective ion monitoring mode (SIM)), or alternatively, ions may be detected using a scanning mode, e.g., multiple reaction monitoring (MRM) or selected reaction monitoring (SRM).

Liquid chromatography-multiple reaction monitoring (LC-MS/MRM) coupled with stable isotope labeled dilution of peptide standards has been shown to be an effective method for protein verification (e.g., Keshishian et al., Mol Cell Proteomics 2009 8: 2339-2349; Kuhn et al., Clin Chem 2009 55:1108-1117; Lopez et al., Clin Chem 2010 56:281-290; each of which are herein incorporated by reference in its entirety). Unlike untargeted mass spectrometry frequently used in biomarker discovery studies, targeted MS methods are peptide sequence-based modes of MS that focus the full analytical capacity of the instrument on tens to hundreds of selected peptides in a complex mixture. By restricting detection and fragmentation to only those peptides derived from proteins of interest, sensitivity and reproducibility are improved dramatically compared to discovery-mode MS methods. This method of mass spectrometry-based multiple reaction monitoring (MRM) quantitation of proteins can dramatically impact the discovery and quantitation of biomarkers via rapid, targeted, multiplexed protein expression profiling of clinical samples.

In one embodiment, a biological sample which may contain at least one protein encoded by at least one modified mRNA of the present invention may be analyzed by the method of MRM-MS. The quantification of the biological sample may further include, but is not limited to, isotopically labeled peptides or proteins as internal standards.

According to the present invention, the biological sample, once obtained from the subject, may be subjected to enzyme digestion. As used herein, the term "digest" means to break apart into shorter peptides. As used herein, the phrase "treating a sample to digest proteins" means manipulating a sample in such a way as to break down proteins in a sample. These enzymes include, but are not limited to, trypsin, endoproteinase Glu-C and chymotrypsin. In one embodiment, a biological sample which may contain at least one protein encoded by at least one modified mRNA of the present invention may be digested using enzymes.

In one embodiment, a biological sample which may contain protein encoded by modified mRNA of the present invention may be analyzed for protein using electrospray ionization. Electrospray ionization (ESI) mass spectrometry (ESIMS) uses electrical energy to aid in the transfer of ions from the solution to the gaseous phase before they are analyzed by mass spectrometry. Samples may be analyzed using methods known in the art (e.g., Ho et al., Clin Biochem Rev. 2003 24(1):3-12; herein incorporated by reference in its entirety). The ionic species contained in solution may be transferred into the gas phase by dispersing a fine spray of charge droplets, evaporating the solvent and ejecting the ions from the charged droplets to generate a mist of highly charged droplets. The mist of highly charged droplets may be analyzed using at least 1, at least 2, at least 3 or at least 4 mass analyzers such as, but not limited to, a quadropole mass analyzer. Further, the mass spectrometry method may include a purification step. As a non-limiting example, the first quadrapole may be set to select a single m/z ratio so it may filter out other molecular ions having a different m/z ratio which may eliminate complicated and time-consuming sample purification procedures prior to MS analysis.

In one embodiment, a biological sample which may contain protein encoded by modified mRNA of the present invention may be analyzed for protein in a tandem ESIMS system (e.g., MS/MS). As non-limiting examples, the droplets may be analyzed using a product scan (or daughter scan) a precursor scan (parent scan) a neutral loss or a multiple reaction monitoring.

In one embodiment, a biological sample which may contain protein encoded by modified mRNA of the present invention may be analyzed using matrix-assisted laser desorption/ionization (MALDI) mass spectrometry (MALDIMS). MALDI provides for the nondestructive vaporization and ionization of both large and small molecules, such as proteins. In MALDI analysis, the analyte is first co-crystallized with a large molar excess of a matrix compound, which may also include, but is not limited to, an ultraviolet absorbing weak organic acid. Non-limiting examples of matrices used in MALDI are α-cyano-4-hydroxycinnamic acid, 3,5-dimethoxy-4-hydroxycinnamic acid and 2,5-dihydroxybenzoic acid. Laser radiation of the analyte-matrix mixture may result in the vaporization of the matrix and the analyte. The laser induced desorption provides high ion yields of the intact analyte and allows for measurement of compounds with high accuracy. Samples may be analyzed using methods known in the art (e.g., Lewis, Wei and Siuzdak, Encyclopedia of Analytical Chemistry 2000:5880-5894; herein incorporated by reference in its entirety). As non-limiting examples, mass analyzers used in the MALDI analysis may include a linear time-of-flight (TOF), a TOF reflectron or a Fourier transform mass analyzer.

In one embodiment, the analyte-matrix mixture may be formed using the dried-droplet method. A biologic sample is mixed with a matrix to create a saturated matrix solution where the matrix-to-sample ratio is approximately 5000:1. An aliquot (approximately 0.5-2.0 uL) of the saturated matrix solution is then allowed to dry to form the analyte-matrix mixture.

In one embodiment, the analyte-matrix mixture may be formed using the thin-layer method. A matrix homogeneous film is first formed and then the sample is then applied and may be absorbed by the matrix to form the analyte-matrix mixture.

In one embodiment, the analyte-matrix mixture may be formed using the thick-layer method. A matrix homogeneous film is formed with a nitro-cellulose matrix additive. Once the uniform nitro-cellulose matrix layer is obtained the sample is applied and absorbed into the matrix to form the analyte-matrix mixture.

In one embodiment, the analyte-matrix mixture may be formed using the sandwich method. A thin layer of matrix crystals is prepared as in the thin-layer method followed by the addition of droplets of aqueous trifluoroacetic acid, the sample and matrix. The sample is then absorbed into the matrix to form the analyte-matrix mixture.

V. USES OF ONCOLOGY-RELATED POLYNUCLEOTIDES, ONCOLOGY-RELATED PRIMARY CONSTRUCTS AND ONCOLOGY-RELATED MMRNA OF THE INVENTION

The oncology-related polynucleotides, oncology-related primary constructs and oncology-related mmRNA of the present invention are designed, in preferred embodiments, to provide for avoidance or evasion of deleterious bio-responses such as the immune response and/or degradation pathways, overcoming the threshold of expression and/or improving protein production capacity, improved expression rates or translation efficiency, improved drug or protein half life and/or protein concentrations, optimized protein localization, to improve one or more of the stability and/or clearance in tissues, receptor uptake and/or kinetics, cellular access by the compositions, engagement with translational machinery, secretion efficiency (when applicable), accessibility to circulation, and/or modulation of a cell's status, function and/or activity.

Therapeutics
Therapeutic Agents

The oncology-related polynucleotides, oncology-related primary constructs or oncology-related mmRNA of the present invention, such as modified nucleic acids and modified RNAs, and the proteins translated from them described herein can be used as therapeutic or prophylactic agents. They are provided for use in medicine. For example, an oncology-related polynucleotide, oncology-related primary construct or oncology-related mmRNA described herein can be administered to a subject, wherein the oncology-related polynucleotide, oncology-related primary construct or oncology-related mmRNA is translated in vivo to produce a therapeutic or prophylactic oncology-related polypeptide in the subject. Provided are compositions, methods, kits, and reagents for diagnosis, treatment or prevention of a disease or condition in humans and other mammals. The active therapeutic agents of the invention include oncology-related polynucleotides, oncology-related primary constructs or oncology-related mmRNA, cells containing oncology-related polynucleotides, oncology-related primary constructs or oncology-related mmRNA or polypeptides translated from the oncology-related polynucleotides, oncology-related primary constructs or oncology-related mmRNA.

In certain embodiments, provided herein are combination therapeutics containing one or more oncology-related polynucleotide, oncology-related primary construct or oncology-related mmRNA containing translatable regions that encode for a protein or proteins that boost a mammalian subject's immunity along with a protein that induces antibody-dependent cellular toxicity. For example, provided herein are therapeutics containing one or more nucleic acids that encode trastuzumab and granulocyte-colony stimulating factor (G-CSF). In particular, such combination therapeutics are useful in Her2+ breast cancer patients who develop induced resistance to trastuzumab. (See, e.g., Albrecht, Immunotherapy. 2(6):795-8 (2010)).

Provided herein are methods of inducing translation of a recombinant polypeptide in a cell population using the oncology-related polynucleotide, oncology-related primary construct or oncology-related mmRNA described herein. Such translation can be in vivo, ex vivo, in culture, or in vitro. The cell population is contacted with an effective amount of a composition containing an oncology-related nucleic acid that has at least one nucleoside modification, and a translatable region encoding the recombinant oncology-related polypeptide. The population is contacted under conditions such that the oncology-related nucleic acid is localized into one or more cells of the cell population and the recombinant oncology-related polypeptide is translated in the cell from the oncology-related nucleic acid.

An "effective amount" of the composition is provided based, at least in part, on the target tissue, target cell type, means of administration, physical characteristics of the nucleic acid (e.g., size, and extent of modified nucleosides), and other determinants. In general, an effective amount of the composition provides efficient protein production in the cell, preferably more efficient than a composition containing a corresponding unmodified nucleic acid. Increased efficiency may be demonstrated by increased cell transfection (i.e., the percentage of cells transfected with the nucleic acid), increased protein translation from the nucleic acid, decreased nucleic acid degradation (as demonstrated, e.g., by increased duration of protein translation from a modified nucleic acid), or reduced innate immune response of the host cell.

Aspects of the invention are directed to methods of inducing in vivo translation of a recombinant polypeptide in a mammalian subject in need thereof. Therein, an effective amount of a composition containing a nucleic acid that has at least one structural or chemical modification and a translatable region encoding the recombinant polypeptide is administered to the subject using the delivery methods described herein. The nucleic acid is provided in an amount and under other conditions such that the nucleic acid is localized into a cell of the subject and the recombinant polypeptide is translated in the cell from the nucleic acid. The cell in which the nucleic acid is localized, or the tissue in which the cell is present, may be targeted with one or more than one rounds of nucleic acid administration.

In certain embodiments, the administered oncology-related polynucleotide, oncology-related primary construct or oncology-related mmRNA directs production of one or more recombinant polypeptides that provide a functional activity which is substantially absent in the cell, tissue or organism in which the recombinant oncology-related polypeptide is translated. For example, the missing functional activity may be enzymatic, structural, or gene regulatory in nature. In related embodiments, the administered oncology-related polynucleotide, oncology-related primary construct or oncology-related mmRNA directs production of one or more recombinant oncology-related polypeptides that increases (e.g., synergistically) a functional activity which is present but substantially deficient in the cell in which the recombinant oncology-related polypeptide is translated.

In other embodiments, the administered oncology-related polynucleotide, oncology-related primary construct or oncology-related mmRNA directs production of one or more recombinant oncology-related polypeptides that replace an oncology-related polypeptide (or multiple oncology-related polypeptides) that is substantially absent in the cell in which the recombinant oncology-related polypeptide is translated. Such absence may be due to genetic mutation of the encoding gene or regulatory pathway thereof. In some embodiments, the recombinant oncology-related polypeptide increases the level of an endogenous oncology-related protein in the cell to a desirable level; such an increase may bring the level of the endogenous oncology-related protein from a subnormal level to a normal level or from a normal level to a super-normal level.

Alternatively, the recombinant oncology-related polypeptide functions to antagonize the activity of an endogenous protein present in, on the surface of, or secreted from the cell. Usually, the activity of the endogenous oncology-related protein is deleterious to the subject; for example, due to mutation of the endogenous oncology-related protein resulting in altered activity or localization. Additionally, the recombinant oncology-related polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity.

The recombinant oncology-related proteins described herein may be engineered for localization within the cell, potentially within a specific compartment such as the nucleus, or are engineered for secretion from the cell or translocation to the plasma membrane of the cell.

In some embodiments, modified oncology-related mRNAs and their encoded oncology-related polypeptides in accordance with the present invention may be used for treatment of any of a variety of diseases, disorders, and/or conditions described herein.

Provided herein, are methods to prevent infection and/or sepsis in a subject at risk of developing infection and/or sepsis, the method comprising administering to a subject in need of such prevention a composition comprising an oncology-related polynucleotide, primary construct or mmRNA precursor encoding an anti-microbial polypeptide (e.g., an anti-bacterial polypeptide), or a partially or fully processed form thereof in an amount sufficient to prevent infection and/or sepsis. In certain embodiments, the subject at risk of developing infection and/or sepsis may be a cancer patient. In certain embodiments, the cancer patient may have undergone a conditioning regimen. In some embodiments, the conditioning regiment may include, but is not limited to, chemotherapy, radiation therapy, or both.

Further provided herein, are methods to treat infection and/or sepsis in a subject, the method comprising administering to a subject in need of such treatment a composition comprising an oncology-related polynucleotide, primary construct or mmRNA precursor encoding an anti-microbial polypeptide (e.g., an anti-bacterial polypeptide), e.g., an anti-microbial polypeptide described herein, or a partially or fully processed form thereof in an amount sufficient to treat an infection and/or sepsis. In certain embodiments, the subject in need of treatment is a cancer patient. In certain embodiments, the cancer patient has undergone a conditioning regimen. In some embodiments, the conditioning regiment may include, but is not limited to, chemotherapy, radiation therapy, or both.

In certain embodiments, the subject may exhibits acute or chronic microbial infections (e.g., bacterial infections). In certain embodiments, the subject may have received or may be receiving a therapy. In certain embodiments, the therapy may include, but is not limited to, radiotherapy, chemotherapy, steroids, ultraviolet radiation, or a combination thereof. In certain embodiments, the patient may suffer from a microvascular disorder. In some embodiments, the microvascular disorder may be diabetes. In certain embodiments, the patient may have a wound. In some embodiments, the wound may be an ulcer. In a specific embodiment, the wound may be a diabetic foot ulcer. In certain embodiments, the subject may have one or more burn wounds. In certain embodiments, the administration may be local or systemic. In certain embodiments, the administration may be subcutaneous. In certain embodiments, the administration may be intravenous. In certain embodiments, the administration may be oral. In certain embodiments, the administration may be topical. In certain embodiments, the administration may be by inhalation. In certain embodiments, the administration may be rectal. In certain embodiments, the administration may be vaginal.

Other aspects of the present disclosure relate to transplantation of cells containing oncology-related polynucleotide, primary construct, or mmRNA to a mammalian subject. Administration of cells to mammalian subjects is known to those of ordinary skill in the art, and include, but is not limited to, local implantation (e.g., topical or subcutaneous administration), organ delivery or systemic injection (e.g., intravenous injection or inhalation), and the formulation of cells in pharmaceutically acceptable carrier. Such compositions containing oncology-related polynucleotide, primary construct, or mmRNA can be formulated for administration intramuscularly, transarterially, intraperitoneally, intravenously, intranasally, subcutaneously, endoscopically, transdermally, or intrathecally. In some embodiments, the composition may be formulated for extended release.

The subject to whom the therapeutic agent may be administered suffers from or may be at risk of developing a disease, disorder, or deleterious condition. Provided are methods of identifying, diagnosing, and classifying subjects on these bases, which may include clinical diagnosis, biomarker levels, genome-wide association studies (GWAS), and other methods known in the art.

Oncology-Related Applications

In one embodiment, the oncology-related polynucleotides, oncology-related primary constructs and/or oncology-related mmRNA may be used in the treatment, management, characterization and/or diagnosis of cancer, a cancer-related and/or a cancer treatment-related disorder, side effect and/or condition. Such disease, disorders and conditions include, but are not limited to, adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, fallopian tube cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, thymus cancer, thyroid cancer, uterine sarcoma, vaginal cancer, vulvar cancer, Waldenstrom macroglobulinemia, Wilms tumor.

In another embodiment, the oncology-related polynucleotides, oncology-related primary constructs and/or oncology-related mmRNA may be used in the treating, managing or manipulating at least one cancer-related or cancer treatment-related disorder, side effect or condition such as chemo brain, peripheral neuropathy, fatigue, depression, nausea and vomiting, pain, anemia, lymphedema, infections, second cancers caused by cancer treatment, sexual side effects, reduced fertility or infertility, ostomies, insomnia and hair loss.

In one embodiment, the oncology-related polynucleotides, oncology-related primary constructs and/or oncology-related mmRNA may be used to reduce the effect of at least one symptom of cancer in a subject. The symptom may include, but is not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness.

Common Categories of Cancer

Brain Cancer

Brain cancer is the growth of abnormal cells in the tissues of the brain usually related to the growth of malignant brain tumors. Brain tumors grow and press on the nearby areas of the brain which can stop that part of the brain from working the way it should. Brain cancer rarely spreads into other tissues outside of the brain. The grade of tumor, based on how abnormal the cancer cells look under a microscope, may be used to tell the difference between slow- and fast-growing tumors. Grade I tumors grow slowly, rarely spreads into nearby tissues, has cells that look like normal cells and the entire tumor may be removable by surgery. Grade II tumors also grow slowly but may spread into nearby tissue and may recur. Grade III tumors grow quickly, is likely to spread into nearby tissue and the tumor cells look very different from normal cells. Grade IV, high-grade, grows and spreads very quickly and there may be areas of dead cells in the tumor. Symptoms of brain cancer may include, but are not limited to, morning headache or headache that goes away after vomiting, frequent nausea and vomiting, vision, hearing, and speech problems, loss of balance and trouble walking, weakness on one side of the body, unusual sleepiness or change in activity level, unusual changes in personality or behavior, seizures.

In one embodiment, the oncology-related polynucleotides, oncology-related primary constructs or oncology-related mmRNA of the present invention may be used to treat a disease, disorder and/or condition in a subject who has been diagnosed or may be diagnosed with brain cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with brain cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with brain cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6658, 6684, 6685, 6686, 6697, 6698, 6699, 6700, 6701, 6702, 6703, 6704, 6705, 6706, 6707, 6708, 6709, 6710, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7305, 7306, 7307, 7308, 7309, 7310, 7311, 7312, 7313, 7314, 7315, 7316, 7317, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7594, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Breast Cancer

Breast cancer forms in the tissues of the breast, of both men and women, such as, but not limited to, the ducts and the lobules. The most common type of breast cancer is ductal carcinoma which begins in the cells of the ducts. Lobular cancer, which begins in the lobes or lobules, is often found in both breasts. An uncommon type of breast cancer, inflammatory breast cancer, causes the breast to be warm, red and swollen. Hereditary breast cancer makes up approximately 5-10% of all breast cancer and altered genes are common in some ethnic groups making that ethnic group more susceptible to breast cancer. Symptoms of breast cancer include, but are not limited to, a lump or thickening in or near the breast or in the underarm area, change in the size or shape of the breast, dimple or puckering in the skin of the breast, inward turned nipple of the breast, fluid from the nipple which is not breast milk, scaly, red or swollen skin on the breast, nipple, or areola, and dimples in the breast that look like the skin of orange (peau d'orange).

In one embodiment, the oncology-related polynucleotides, oncology-related primary constructs or oncology-related mmRNA of the present invention may be used to treat a disease, disorder and/or condition in a subject who has been diagnosed or may be diagnosed with breast cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with breast cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with breast cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4753, 4756, 4757, 4758, 4759, 4761, 4762, 4776, 4777, 4778, 4779, 4780, 4781, 4782, 4783, 4784, 4785, 4786, 4787, 4788, 4789, 4790, 4825, 4826, 4827, 4828, 4829, 4830, 4832, 4835, 4836, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4946, 4947, 4948, 4949, 4950, 4958, 4959, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5142, 5143, 5144, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5282, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5660, 5661, 5662, 5663, 5664, 5665, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5704, 5705, 5706, 5707, 5708, 5709, 5710, 5711, 5712, 5713, 5714, 5715, 5716, 5717, 5727, 5740, 5741, 5742, 5743, 5744, 5745, 5746, 5747, 5748, 5749, 5750, 5751, 5752, 5753, 5754, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5781, 5782, 5783, 5784, 5785, 5786, 5787, 5788, 5789, 5790, 5791, 5792, 5793, 5794, 5795, 5796, 5797, 5798, 5799, 5800, 5801, 5802, 5803, 5806, 5807, 5808, 5809, 5810, 5811, 5812, 5813, 5814, 5821, 5822, 5823, 5824, 5825, 5826, 5827, 5828, 5829, 5830, 5831, 5832, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6283, 6284, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6327, 6328, 6329, 6333, 6334, 6335, 6336, 6337, 6338, 6339, 6340, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6524, 6525, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6697, 6698, 6699, 6700, 6701, 6718, 6719, 6721, 6723, 6724, 6737, 6738, 6739, 6740, 6741, 6742, 6743, 6747, 6748, 6749, 6750, 6751, 6752, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6870, 6871, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7027, 7028, 7029, 7030, 7034, 7035, 7045, 7046, 7047, 7048, 7049, 7050, 7051, 7052, 7053, 7054, 7055, 7056, 7057, 7058, 7059, 7060, 7084, 7086, 7087, 7088, 7089, 7090, 7091, 7092, 7093, 7094, 7095, 7096, 7097, 7098, 7099, 7100, 7101, 7102, 7103, 7104, 7105, 7106, 7125, 7126, 7127, 7128, 7129, 7130, 7131, 7132, 7133, 7134, 7135, 7136, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7347, 7348, 7349, 7358, 7359, 7360, 7361, 7362, 7363, 7364, 7365, 7368, 7369, 7370, 7371, 7372, 7373, 7374, 7375, 7376, 7377, 7378, 7380, 7383, 7415, 7416, 7417, 7438, 7443, 7444, 7445, 7446, 7447, 7448, 7449, 7450, 7451, 7452, 7453, 7454, 7455, 7456, 7457, 7471, 7472, 7473, 7474, 7475, 7476, 7477, 7484, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7798, 7799, 7800, 7801, 7802, 7803, 7804, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8183, 8184, 8185, 8186, 8187, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8313, 8314, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8504, 8505, 8506, 8508, 8509, 8510, 8511, 8512, 8514, 8515, 8546, 8547, 8548, 8549, 8550, 8551, 8552, 8553, 8554, 8555, 8568, 8569, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8835, 8836, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8905, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9036, 9037, 9038, 9039, 9040, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9099, 9100, 9101, 9102, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Cervical Cancer

Cervical cancer forms in the tissues of the cervic and is usually slow-growing. The cause of cervical cancer usually related to the human papillomavirus (HPV) infection. Although cervical cancer may not show any signs, possible symptoms may include, but are not limited to, vaginal bleeding, unusual vaginal discharge, pelvic pain and pain during sexual intercourse.

In one embodiment, the oncology-related polynucleotides, oncology-related primary constructs or oncology-related mmRNA of the present invention may be used to treat a disease, disorder and/or condition in a subject who has been diagnosed or may be diagnosed with cervical cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with cervical cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with cervical cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4854, 4855, 4856, 4857, 4858, 4859, 4860, 4861, 4863, 4864, 4865, 4866, 4867, 4868, 4869, 4871, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4964, 4965, 4966, 4967, 4968, 4969, 4970, 4971, 4972, 4973, 4974, 4975, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5316, 5317, 5318, 5319, 5320, 5321, 5322, 5323, 5324, 5325, 5326, 5327, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6697, 6698, 6699, 6700, 6701, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Esophageal Cancer

Esophageal cancer is cancer that forms in the tissues lining the esophagus. There are two common types of esophageal cancer which are named for the type of cells that become malignant. Squamous cell carcinoma is cancer that forms in the thin, flat cells lining the esophagus (also called epidermoid carcinoma). Cancer that begins in the glandular (secretory) cells which produce and release fluids such as mucus is called adneocarcinoma. Common symptoms associated with esophageal cancer include, but are not limited to, painful or difficult swallowing, weight loss, pain behind the breastbone, hoarseness and cough, and indigestion and heartburn.

In one embodiment, the oncology-related polynucleotides, oncology-related primary constructs or oncology-related mmRNA of the present invention may be used to treat a disease, disorder and/or condition in a subject who has been diagnosed or may be diagnosed with esophageal cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with esophageal cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with esophageal cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6697, 6698, 6699, 6700, 6701, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Familial Cancer Syndrome

Familial cancer syndrome describes the genetic predisposition of a subject to develop cancer. 5-10% of all cancers are hereditary and are passed on through specific in specific genes passed from one blood relative to another. Subjects that inherit one of these gene changes may have a higher likelihood of developing cancer within their lifetime. Familial cancer syndrome includes disorder such as, but not limited to, Ataxia Telangiectasia, Basal Cell Nevus Syndrome, Nevoid Basal Cell Carcinoma Syndrome, Gorlin Syndrome, Beckwith Wiedemann Syndrome, Birt-Hogg-Dube Syndrome, Bloom Syndrome, hereditary breast and/or ovarian cancer, Carney Complex, Types I and II, Familial Chordoma, Colon Cancer, Hereditary Nonpolyposis-Lynch Syndrome, Costello Syndrome, Facio-Cutaneous-Skeletal Syndrome, Cowden Syndrome, Dyskeratosis Congenita, Tylosis with Esophaeal Cancer, Keratosis Palmaris et Plantaris with Esophageal Cancer, Howel-Evans Syndrome, Herediatary Multiple Exostosis, Fanconi Anemia, Hereditary Diffuse Gastric Cancer, Gastrointestinal Stromal Tumor, Multiple Gastrointestinal Stromal Tumor, Familial Hyperparathyroidism, Acute Myeloid Leukemia, Familial Leukemia, Chronic Lymphocytic Leukemia, Li-Fraumeni Syndrome, Hodgkin Lymphoma, Non-Hodgkin Lymphoma, Hereditary Multiple Melanoma, Mosaic Varigated Aneuploidy, Multple Endocrine Neoplasia Type I, Type 2A and 2B, Familial Medullary Thyroid Cancer, Familial Mulitple Myeloma, Hereditary Neuroblastoma, Neurofibromatosis Type 1 and 2, Nijmegen Breakage Syndrome, Hereditary Pancreatic Cancer, Hereditary Paraganglioma, Peutz-Jeghers Syndrome, Familial Adenomatous Polyposis, Familial Juvenile Polyposis, MYH-Associated Polyposis, Hereditary Prostate Cancer, Hereditary Renal Cell Carcinoma with Multiple Cutaneous and Uterine Leiomyomas, Hereditary Renal Cell Carcinoma, Hereditary Papillary Renal Cell Carcinoma, Rhabdoid Predisposition Syndrome, Rothmund-Thomson Syndrome, Simpson-Golabi-Behmel Syndrome, Familial Testicular Germ Cell Tumor, Familial Non-medullary Thyroid Carcinoma, Tuberous Sclerosis Complex, von Hippel-Lindau Syndrome, Familial Waldenstrom Macroglobulinemia, Werner Syndrome, Familial Wilms Tumor and Xeroderma Pigmentosum.

In one embodiment, the oncology-related polynucleotides, oncology-related primary constructs or oncology-related mmRNA of the present invention may be used to treat a disease, disorder and/or condition in a subject who has been diagnosed or may be diagnosed with Familial cancer syndrome by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with Familial cancer syndrome by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with Familial cancer syndrome by administering to said subject an isolated polynucleotide encoding an oncology-related polypeptide of interest. In a further embodiment, the oncology-related polypeptide of interest may include, but not limited to, SEQ ID NOs: 4704, 4705, 4706, 4707, 4708, 4709, 4710, 4711, 4712, 4713, 4714, 4715, 4716, 4717, 4718, 4719, 4720, 4721, 4722, 4723, 4724, 4725, 4726, 4727, 4728, 4729, 4730, 4731, 4732, 4733, 4734, 4735, 4736, 4737, 4738, 4739, 4740, 4741, 4742, 4743, 4744, 4745, 4746, 4747, 4748, 4749, 4750, 4751, 4752, 4753, 4754, 4755, 4756, 4757, 4758, 4759, 4760, 4761, 4762, 4763, 4764, 4765, 4766, 4767, 4768, 4769, 4770, 4771, 4772, 4773, 4774, 4775, 4776, 4777, 4778, 4779, 4780, 4781, 4782, 4783, 4784, 4785, 4786, 4787, 4788, 4789, 4790, 4791, 4792, 4793, 4794, 4795, 4796, 4797, 4798, 4799, 4800, 4801, 4802, 4803, 4804, 4805, 4806, 4807, 4808, 4809, 4810, 4811, 4812, 4813, 4814, 4815, 4816, 4817, 4818, 4819, 4820, 4821, 4822, 4823, 4824, 4825, 4826, 4827, 4828, 4829, 4830, 4831, 4832, 4833, 4834, 4835, 4836, 4837, 4838, 4839, 4840, 4841, 4842, 4843, 4844, 4845, 4846, 4847, 4848, 4849, 4850, 4851, 4852, 4853, 4854, 4855, 4856, 4857, 4858, 4859, 4860, 4861, 4862, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4895, 4896, 4897, 4898, 4899, 4900, 4901, 4902, 4903, 4904, 4905, 4906, 4907, 4908, 4909, 4910, 4911, 4912, 4913, 4914, 4915, 4916, 4917, 4918, 4919, 4920, 4921, 4922, 4923, 4924, 4925, 4926, 4927, 4928, 4929, 4930, 4931, 4932, 4933, 4934, 4935, 4936, 4937, 4938, 4939, 4940, 4941, 4942, 4943, 4944, 4945, 4946, 4947, 4948, 4949, 4950, 4951, 4952, 4953, 4954, 4955, 4956, 4957, 4958, 4959, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5003, 5004, 5005, 5006, 5007, 5008, 5009, 5010, 5011, 5012, 5013, 5014, 5015, 5016, 5017, 5018, 5019, 5020, 5021, 5022, 5023, 5024, 5025, 5026, 5027, 5028, 5029, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5080, 5081, 5082, 5083, 5084, 5085, 5086, 5087, 5088, 5089, 5090, 5091, 5092, 5093, 5094, 5095, 5096, 5097, 5098, 5099, 5100, 5101, 5102, 5103, 5104, 5105, 5106, 5107, 5108, 5109, 5110, 5111, 5112, 5113, 5114, 5115, 5116, 5117, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5142, 5143, 5144, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5179, 5180, 5181, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5224, 5225, 5226, 5227, 5228, 5229, 5230, 5231, 5232, 5233, 5234, 5235, 5236, 5237, 5238, 5239, 5240, 5241, 5242, 5243, 5244, 5245, 5246, 5247, 5248, 5249, 5250, 5251, 5252, 5253, 5254, 5255, 5256, 5257, 5258, 5259, 5260, 5261, 5262, 5263, 5264, 5265, 5266, 5267, 5268, 5269, 5270, 5271, 5272, 5273, 5274, 5275, 5276, 5277, 5278, 5279, 5280, 5281, 5282, 5283, 5284, 5285, 5286, 5287, 5288, 5289, 5290, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5403, 5404, 5405, 5406, 5407, 5408, 5409, 5410, 5411, 5412, 5413, 5414, 5415, 5416, 5417, 5418, 5419, 5420, 5421, 5422, 5423, 5424, 5425, 5426, 5427, 5428, 5429, 5430, 5431, 5432, 5433, 5434, 5435, 5436, 5437, 5438, 5439, 5440, 5441, 5442, 5443, 5444, 5445, 5446, 5447, 5448, 5449, 5450, 5451, 5452, 5453, 5454, 5455, 5456, 5457, 5458, 5459, 5460, 5461, 5462, 5463, 5464, 5465, 5466, 5467, 5468, 5469, 5470, 5471, 5472, 5473, 5474, 5475, 5476, 5477, 5478, 5479, 5480, 5481, 5482, 5483, 5484, 5485, 5486, 5487, 5488, 5489, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5537, 5538, 5539, 5540, 5541, 5542, 5543, 5544, 5545, 5546, 5547, 5548, 5549, 5550, 5551, 5552, 5553, 5554, 5555, 5556, 5557, 5558, 5559, 5560, 5561, 5562, 5563, 5564, 5565, 5566, 5567, 5568, 5569, 5570, 5571, 5572, 5573, 5574, 5575, 5576, 5577, 5578, 5579, 5580, 5581, 5582, 5583, 5584, 5585, 5586, 5587, 5588, 5589, 5590, 5591, 5592, 5593, 5594, 5595, 5596, 5597, 5598, 5599, 5600, 5601, 5602, 5603, 5604, 5605, 5606, 5607, 5608, 5609, 5610, 5611, 5612, 5613, 5614, 5615, 5616, 5617, 5618, 5619, 5620, 5621, 5622, 5623, 5624, 5625, 5626, 5627, 5628, 5629, 5630, 5631, 5632, 5633, 5634, 5635, 5636, 5637, 5638, 5639, 5640, 5641, 5642, 5643, 5644, 5645, 5646, 5647, 5648, 5649, 5650, 5651, 5652, 5653, 5654, 5655, 5656, 5657, 5658, 5659, 5660, 5661, 5662, 5663, 5664, 5665, 5666, 5667, 5668, 5669, 5670, 5671, 5672, 5673, 5674, 5675, 5676, 5677, 5678, 5679, 5680, 5681, 5682, 5683, 5684, 5685, 5686, 5687, 5688, 5689, 5690, 5691, 5692, 5693, 5694, 5695, 5696, 5697, 5698, 5699, 5700, 5701, 5702, 5703, 5704, 5705, 5706, 5707, 5708, 5709, 5710, 5711, 5712, 5713, 5714, 5715, 5716, 5717, 5718, 5719, 5720, 5721, 5722, 5723, 5724, 5725, 5726, 5727, 5728, 5729, 5730, 5731, 5732, 5733, 5734, 5735, 5736, 5737, 5738, 5739, 5740, 5741, 5742, 5743, 5744, 5745, 5746, 5747, 5748, 5749, 5750, 5751, 5752, 5753, 5754, 5755, 5756, 5757, 5758, 5759, 5760, 5761, 5762, 5763, 5764, 5765, 5766, 5767, 5768, 5769, 5770, 5771, 5772, 5773, 5774, 5775, 5776, 5777, 5778, 5779, 5780, 5781, 5782, 5783, 5784, 5785, 5786, 5787, 5788, 5789, 5790, 5791, 5792, 5793, 5794, 5795, 5796, 5797, 5798, 5799, 5800, 5801, 5802, 5803, 5804, 5805, 5806, 5807, 5808, 5809, 5810, 5811, 5812, 5813, 5814, 5815, 5816, 5817, 5818, 5819, 5820, 5821, 5822, 5823, 5824, 5825, 5826, 5827, 5828, 5829, 5830, 5831, 5832, 5833, 5834, 5835, 5836, 5837, 5838, 5839, 5840, 5841, 5842, 5843, 5844, 5845, 5846, 5847, 5848, 5849, 5850, 5851, 5852, 5853, 5854, 5855, 5856, 5857, 5858, 5859, 5860, 5861, 5862, 5863, 5864, 5865, 5866, 5867, 5868, 5869, 5870, 5871, 5872, 5873, 5874, 5875, 5876, 5877, 5878, 5879, 5880, 5881, 5882, 5883, 5884, 5885, 5886, 5887, 5888, 5889, 5890, 5891, 5892, 5893, 5894, 5895, 5896, 5897, 5898, 5899, 5900, 5901, 5902, 5903, 5904, 5905, 5906, 5907, 5908, 5909, 5910, 5911, 5912, 5913, 5914, 5915, 5916, 5917, 5918, 5919, 5920, 5921, 5922, 5923, 5924, 5925, 5926, 5927, 5928, 5929, 5930, 5931, 5932, 5933, 5934, 5935, 5936, 5937, 5938, 5939, 5940, 5941, 5942, 5943, 5944, 5945, 5946, 5947, 5948, 5949, 5950, 5951, 5952, 5953, 5954, 5955, 5956, 5957, 5958, 5959, 5960, 5961, 5962, 5963, 5964, 5965, 5966, 5967, 5968, 5969, 5970, 5971, 5972, 5973, 5974, 5975, 5976, 5977, 5978, 5979, 5980, 5981, 5982, 5983, 5984, 5985, 5986, 5987, 5988, 5989, 5990, 5991, 5992, 5993, 5994, 5995, 5996, 5997, 5998, 5999, 6000, 6001, 6002, 6003, 6004, 6005, 6006, 6007, 6008, 6009, 6010, 6011, 6012, 6013, 6014, 6015, 6016, 6017, 6018, 6019, 6020, 6021, 6022, 6023, 6024, 6025, 6026, 6027, 6028, 6029, 6030, 6031, 6032, 6033, 6034, 6035, 6036, 6037, 6038, 6039, 6040, 6041, 6042, 6043, 6044, 6045, 6046, 6047, 6048, 6049, 6050, 6051, 6052, 6053, 6054, 6055, 6056, 6057, 6058, 6059, 6060, 6061, 6062, 6063, 6064, 6065, 6066, 6067, 6068, 6069, 6070, 6071, 6072, 6073, 6074, 6075, 6076, 6077, 6078, 6079, 6080, 6081, 6082, 6083, 6084, 6085, 6086, 6087, 6088, 6089, 6090, 6091, 6092, 6093, 6094, 6095, 6096, 6097, 6098, 6099, 6100, 6101, 6102, 6103, 6104, 6105, 6106, 6107, 6108, 6109, 6110, 6111, 6112, 6113, 6114, 6115, 6116, 6117, 6118, 6119, 6120, 6121, 6122, 6123, 6124, 6125, 6126, 6127, 6128, 6129, 6130, 6131, 6132, 6133, 6134, 6135, 6136, 6137, 6138, 6139, 6140, 6141, 6142, 6143, 6144, 6145, 6146, 6147, 6148, 6149, 6150, 6151, 6152, 6153, 6154, 6155, 6156, 6157, 6158, 6159, 6160, 6161, 6162, 6163, 6164, 6165, 6166, 6167, 6168, 6169, 6170, 6171, 6172, 6173, 6174, 6175, 6176, 6177, 6178, 6179, 6180, 6181, 6182, 6183, 6184, 6185, 6186, 6187, 6188, 6189, 6190, 6191, 6192, 6193, 6194, 6195, 6196, 6197, 6198, 6199, 6200, 6201, 6202, 6203, 6204, 6205, 6206, 6207, 6208, 6209, 6210, 6211, 6212, 6213, 6214, 6215, 6216, 6217, 6218, 6219, 6220, 6221, 6222, 6223, 6224, 6225, 6226, 6227, 6228, 6229, 6230, 6231, 6232, 6233, 6234, 6235, 6236, 6237, 6238, 6239, 6240, 6241, 6242, 6243, 6244, 6245, 6246, 6247, 6248, 6249, 6250, 6251, 6252, 6253, 6254, 6255, 6256, 6257, 6258, 6259, 6260, 6261, 6262, 6263, 6264, 6265, 6266, 6267, 6268, 6269, 6270, 6271, 6272, 6273, 6274, 6275, 6276, 6277, 6278, 6279, 6280, 6281, 6282, 6283, 6284, 6285, 6286, 6287, 6288, 6289, 6290, 6291, 6292, 6293, 6294, 6295, 6296, 6297, 6298, 6299, 6300, 6301, 6302, 6303, 6304, 6305, 6306, 6307, 6308, 6309, 6310, 6311, 6312, 6313, 6314, 6315, 6316, 6317, 6318, 6319, 6320, 6321, 6322, 6323, 6324, 6325, 6326, 6327, 6328, 6329, 6330, 6331, 6332, 6333, 6334, 6335, 6336, 6337, 6338, 6339, 6340, 6341, 6342, 6343, 6344, 6345, 6346, 6347, 6348, 6349, 6350, 6351, 6352, 6353, 6354, 6355, 6356, 6357, 6358, 6359, 6360, 6361, 6362, 6363, 6364, 6365, 6366, 6367, 6368, 6369, 6370, 6371, 6372, 6373, 6374, 6375, 6376, 6377, 6378, 6379, 6380, 6381, 6382, 6383, 6384, 6385, 6386, 6387, 6388, 6389, 6390, 6391, 6392, 6393, 6394, 6395, 6396, 6397, 6398, 6399, 6400, 6401, 6402, 6403, 6404, 6405, 6406, 6407, 6408, 6409, 6410, 6411, 6412, 6413, 6414, 6415, 6416, 6417, 6418, 6419, 6420, 6421, 6422, 6423, 6424, 6425, 6426, 6427, 6428, 6429, 6430, 6431, 6432, 6433, 6434, 6435, 6436, 6437, 6438, 6439, 6440, 6441, 6442, 6443, 6444, 6445, 6446, 6447, 6448, 6449, 6450, 6451, 6452, 6453, 6454, 6455, 6456, 6457, 6458, 6459, 6460, 6461, 6462, 6463, 6464, 6465, 6466, 6467, 6468, 6469, 6470, 6471, 6472, 6473, 6474, 6475, 6476, 6477, 6478, 6479, 6480, 6481, 6482, 6483, 6484, 6485, 6486, 6487, 6488, 6489, 6490, 6491, 6492, 6493, 6494, 6495, 6496, 6497, 6498, 6499, 6500, 6501, 6502, 6503, 6504, 6505, 6506, 6507, 6508, 6509, 6510, 6511, 6512, 6513, 6514, 6515, 6516, 6517, 6518, 6519, 6520, 6521, 6522, 6523, 6524, 6525, 6526, 6527, 6528, 6529, 6530, 6531, 6532, 6533, 6534, 6535, 6536, 6537, 6538, 6539, 6540, 6541, 6542, 6543, 6544, 6545, 6546, 6547, 6548, 6549, 6550, 6551, 6552, 6553, 6554, 6555, 6556, 6557, 6558, 6559, 6560, 6561, 6562, 6563, 6564, 6565, 6566, 6567, 6568, 6569, 6570, 6571, 6572, 6573, 6574, 6575, 6576, 6577, 6578, 6579, 6580, 6581, 6582, 6583, 6584, 6585, 6586, 6587, 6588, 6589, 6590, 6591, 6592, 6593, 6594, 6595, 6596, 6597, 6598, 6599, 6600, 6601, 6602, 6603, 6604, 6605, 6606, 6607, 6608, 6609, 6610, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6635, 6636, 6637, 6638, 6639, 6640, 6641, 6642, 6643, 6644, 6645, 6646, 6647, 6648, 6649, 6650, 6651, 6652, 6653, 6654, 6655, 6656, 6657, 6658, 6659, 6660, 6661, 6662, 6663, 6664, 6665, 6666, 6667, 6668, 6669, 6670, 6671, 6672, 6673, 6674, 6675, 6676, 6677, 6678, 6679, 6680, 6681, 6682, 6683, 6684, 6685, 6686, 6687, 6688, 6689, 6690, 6691, 6692, 6693, 6694, 6695, 6696, 6697, 6698, 6699, 6700, 6701, 6702, 6703, 6704, 6705, 6706, 6707, 6708, 6709, 6710, 6711, 6712, 6713, 6714, 6715, 6716, 6717, 6718, 6719, 6720, 6721, 6722, 6723, 6724, 6725, 6726, 6727, 6728, 6729, 6730, 6731, 6732, 6733, 6734, 6735, 6736, 6737, 6738, 6739, 6740, 6741, 6742, 6743, 6744, 6745, 6746, 6747, 6748, 6749, 6750, 6751, 6752, 6753, 6754, 6755, 6756, 6757, 6758, 6759, 6760, 6761, 6762, 6763, 6764, 6765, 6766, 6767, 6768, 6769, 6770, 6771, 6772, 6773, 6774, 6775, 6776, 6777, 6778, 6779, 6780, 6781, 6782, 6783, 6784, 6785, 6786, 6787, 6788, 6789, 6790, 6791, 6792, 6793, 6794, 6795, 6796, 6797, 6798, 6799, 6800, 6801, 6802, 6803, 6804, 6805, 6806, 6807, 6808, 6809, 6810, 6811, 6812, 6813, 6814, 6815, 6816, 6817, 6818, 6819, 6820, 6821, 6822, 6823, 6824, 6825, 6826, 6827, 6828, 6829, 6830, 6831, 6832, 6833, 6834, 6835, 6836, 6837, 6838, 6839, 6840, 6841, 6842, 6843, 6844, 6845, 6846, 6847, 6848, 6849, 6850, 6851, 6852, 6853, 6854, 6855, 6856, 6857, 6858, 6859, 6860, 6861, 6862, 6863, 6864, 6865, 6866, 6867, 6868, 6869, 6870, 6871, 6872, 6873, 6874, 6875, 6876, 6877, 6878, 6879, 6880, 6881, 6882, 6883, 6884, 6885, 6886, 6887, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6937, 6938, 6939, 6940, 6941, 6942, 6943, 6944, 6945, 6946, 6947, 6948, 6949, 6950, 6951, 6952, 6953, 6954, 6955, 6956, 6957, 6958, 6959, 6960, 6961, 6962, 6963, 6964, 6965, 6966, 6967, 6968, 6969, 6970, 6971, 6972, 6973, 6974, 6975, 6976, 6977, 6978, 6979, 6980, 6981, 6982, 6983, 6984, 6985, 6986, 6987, 6988, 6989, 6990, 6991, 6992, 6993, 6994, 6995, 6996, 6997, 6998, 6999, 7000, 7001, 7002, 7003, 7004, 7005, 7006, 7007, 7008, 7009, 7010, 7011, 7012, 7013, 7014, 7015, 7016, 7017, 7018, 7019, 7020, 7021, 7022, 7023, 7024, 7025, 7026, 7027, 7028, 7029, 7030, 7031, 7032, 7033, 7034, 7035, 7036, 7037, 7038, 7039, 7040, 7041, 7042, 7043, 7044, 7045, 7046, 7047, 7048, 7049, 7050, 7051, 7052, 7053, 7054, 7055, 7056, 7057, 7058, 7059, 7060, 7061, 7062, 7063, 7064, 7065, 7066, 7067, 7068, 7069, 7070, 7071, 7072, 7073, 7074, 7075, 7076, 7077, 7078, 7079, 7080, 7081, 7082, 7083, 7084, 7085, 7086, 7087, 7088, 7089, 7090, 7091, 7092, 7093, 7094, 7095, 7096, 7097, 7098, 7099, 7100, 7101, 7102, 7103, 7104, 7105, 7106, 7107, 7108, 7109, 7110, 7111, 7112, 7113, 7114, 7115, 7116, 7117, 7118, 7119, 7120, 7121, 7122, 7123, 7124, 7125, 7126, 7127, 7128, 7129, 7130, 7131, 7132, 7133, 7134, 7135, 7136, 7137, 7138, 7139, 7140, 7141, 7142, 7143, 7144, 7145, 7146, 7147, 7148, 7149, 7150, 7151, 7152, 7153, 7154, 7155, 7156, 7157, 7158, 7159, 7160, 7161, 7162, 7163, 7164, 7165, 7166, 7167, 7168, 7169, 7170, 7171, 7172, 7173, 7174, 7175, 7176, 7177, 7178, 7179, 7180, 7181, 7182, 7183, 7184, 7185, 7186, 7187, 7188, 7189, 7190, 7191, 7192, 7193, 7194, 7195, 7196, 7197, 7198, 7199, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7242, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7272, 7273, 7274, 7275, 7276, 7277, 7278, 7279, 7280, 7281, 7282, 7283, 7284, 7285, 7286, 7287, 7288, 7289, 7290, 7291, 7292, 7293, 7294, 7295, 7296, 7297, 7298, 7299, 7300, 7301, 7302, 7303, 7304, 7305, 7306, 7307, 7308, 7309, 7310, 7311, 7312, 7313, 7314, 7315, 7316, 7317, 7318, 7319, 7320, 7321, 7322, 7323, 7324, 7325, 7326, 7327, 7328, 7329, 7330, 7331, 7332, 7333, 7334, 7335, 7336, 7337, 7338, 7339, 7340, 7341, 7342, 7343, 7344, 7345, 7346, 7347, 7348, 7349, 7350, 7351, 7352, 7353, 7354, 7355, 7356, 7357, 7358, 7359, 7360, 7361, 7362, 7363, 7364, 7365, 7366, 7367, 7368, 7369, 7370, 7371, 7372, 7373, 7374, 7375, 7376, 7377, 7378, 7379, 7380, 7381, 7382, 7383, 7384, 7385, 7386, 7387, 7388, 7389, 7390, 7391, 7392, 7393, 7394, 7395, 7396, 7397, 7398, 7399, 7400, 7401, 7402, 7403, 7404, 7405, 7406, 7407, 7408, 7409, 7410, 7411, 7412, 7413, 7414, 7415, 7416, 7417, 7418, 7419, 7420, 7421, 7422, 7423, 7424, 7425, 7426, 7427, 7428, 7429, 7430, 7431, 7432, 7433, 7434, 7435, 7436, 7437, 7438, 7439, 7440, 7441, 7442, 7443, 7444, 7445, 7446, 7447, 7448, 7449, 7450, 7451, 7452, 7453, 7454, 7455, 7456, 7457, 7458, 7459, 7460, 7461, 7462, 7463, 7464, 7465, 7466, 7467, 7468, 7469, 7470, 7471, 7472, 7473, 7474, 7475, 7476, 7477, 7478, 7479, 7480, 7481, 7482, 7483, 7484, 7485, 7486, 7487, 7488, 7489, 7490, 7491, 7492, 7493, 7494, 7495, 7496, 7497, 7498, 7499, 7500, 7501, 7502, 7503, 7504, 7505, 7506, 7507, 7508, 7509, 7510, 7511, 7512, 7513, 7514, 7515, 7516, 7517, 7518, 7519, 7520, 7521, 7522, 7523, 7524, 7525, 7526, 7527, 7528, 7529, 7530, 7531, 7532, 7533, 7534, 7535, 7536, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7561, 7562, 7563, 7564, 7565, 7566, 7567, 7568, 7569, 7570, 7571, 7572, 7573, 7574, 7575, 7576, 7577, 7578, 7579, 7580, 7581, 7582, 7583, 7584, 7585, 7586, 7587, 7588, 7589, 7590, 7591, 7592, 7593, 7594, 7595, 7596, 7597, 7598, 7599, 7600, 7601, 7602, 7603, 7604, 7605, 7606, 7607, 7608, 7609, 7610, 7611, 7612, 7613, 7614, 7615, 7616, 7617, 7618, 7619, 7620, 7621, 7622, 7623, 7624, 7625, 7626, 7627, 7628, 7629, 7630, 7631, 7632, 7633, 7634, 7635, 7636, 7637, 7638, 7639, 7640, 7641, 7642, 7643, 7644, 7645, 7646, 7647, 7648, 7649, 7650, 7651, 7652, 7653, 7654, 7655, 7656, 7657, 7658, 7659, 7660, 7661, 7662, 7663, 7664, 7665, 7666, 7667, 7668, 7669, 7670, 7671, 7672, 7673, 7674, 7675, 7676, 7677, 7678, 7679, 7680, 7681, 7682, 7683, 7684, 7685, 7686, 7687, 7688, 7689, 7690, 7691, 7692, 7693, 7694, 7695, 7696, 7697, 7698, 7699, 7700, 7701, 7702, 7703, 7704, 7705, 7706, 7707, 7708, 7709, 7710, 7711, 7712, 7713, 7714, 7715, 7716, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7745, 7746, 7747, 7748, 7749, 7750, 7751, 7752, 7753, 7754, 7755, 7756, 7757, 7758, 7759, 7760, 7761, 7762, 7763, 7764, 7765, 7766, 7767, 7768, 7769, 7770, 7771, 7772, 7773, 7774, 7775, 7776, 7777, 7778, 7779, 7780, 7781, 7782, 7783, 7784, 7785, 7786, 7787, 7788, 7789, 7790, 7791, 7792, 7793, 7794, 7795, 7796, 7797, 7798, 7799, 7800, 7801, 7802, 7803, 7804, 7805, 7806, 7807, 7808, 7809, 7810, 7811, 7812, 7813, 7814, 7815, 7816, 7817, 7818, 7819, 7820, 7821, 7822, 7823, 7824, 7825, 7826, 7827, 7828, 7829, 7830, 7831, 7832, 7833, 7834, 7835, 7836, 7837, 7838, 7839, 7840, 7841, 7842, 7843, 7844, 7845, 7846, 7847, 7848, 7849, 7850, 7851, 7852, 7853, 7854, 7855, 7856, 7857, 7858, 7859, 7860, 7861, 7862, 7863, 7864, 7865, 7866, 7867, 7868, 7869, 7870, 7871, 7872, 7873, 7874, 7875, 7876, 7877, 7878, 7879, 7880, 7881, 7882, 7883, 7884, 7885, 7886, 7887, 7888, 7889, 7890, 7891, 7892, 7893, 7894, 7895, 7896, 7897, 7898, 7899, 7900, 7901, 7902, 7903, 7904, 7905, 7906, 7907, 7908, 7909, 7910, 7911, 7912, 7913, 7914, 7915, 7916, 7917, 7918, 7919, 7920, 7921, 7922, 7923, 7924, 7925, 7926, 7927, 7928, 7929, 7930, 7931, 7932, 7933, 7934, 7935, 7936, 7937, 7938, 7939, 7940, 7941, 7942, 7943, 7944, 7945, 7946, 7947, 7948, 7949, 7950, 7951, 7952, 7953, 7954, 7955, 7956, 7957, 7958, 7959, 7960, 7961, 7962, 7963, 7964, 7965, 7966, 7967, 7968, 7969, 7970, 7971, 7972, 7973, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8001, 8002, 8003, 8004, 8005, 8006, 8007, 8008, 8009, 8010, 8011, 8012, 8013, 8014, 8015, 8016, 8017, 8018, 8019, 8020, 8021, 8022, 8023, 8024, 8025, 8026, 8027, 8028, 8029, 8030, 8031, 8032, 8033, 8034, 8035, 8036, 8037, 8038, 8039, 8040, 8041, 8042, 8043, 8044, 8045, 8046, 8047, 8048, 8049, 8050, 8051, 8052, 8053, 8054, 8055, 8056, 8057, 8058, 8059, 8060, 8061, 8062, 8063, 8064, 8065, 8066, 8067, 8068, 8069, 8070, 8071, 8072, 8073, 8074, 8075, 8076, 8077, 8078, 8079, 8080, 8081, 8082, 8083, 8084, 8085, 8086, 8087, 8088, 8089, 8090, 8091, 8092, 8093, 8094, 8095, 8096, 8097, 8098, 8099, 8100, 8101, 8102, 8103, 8104, 8105, 8106, 8107, 8108, 8109, 8110, 8111, 8112, 8113, 8114, 8115, 8116, 8117, 8118, 8119, 8120, 8121, 8122, 8123, 8124, 8125, 8126, 8127, 8128, 8129, 8130, 8131, 8132, 8133, 8134, 8135, 8136, 8137, 8138, 8139, 8140, 8141, 8142, 8143, 8144, 8145, 8146, 8147, 8148, 8149, 8150, 8151, 8152, 8153, 8154, 8155, 8156, 8157, 8158, 8159, 8160, 8161, 8162, 8163, 8164, 8165, 8166, 8167, 8168, 8169, 8170, 8171, 8172, 8173, 8174, 8175, 8176, 8177, 8178, 8179, 8180, 8181, 8182, 8183, 8184, 8185, 8186, 8187, 8188, 8189, 8190, 8191, 8192, 8193, 8194, 8195, 8196, 8197, 8198, 8199, 8200, 8201, 8202, 8203, 8204, 8205, 8206, 8207, 8208, 8209, 8210, 8211, 8212, 8213, 8214, 8215, 8216, 8217, 8218, 8219, 8220, 8221, 8222, 8223, 8224, 8225, 8226, 8227, 8228, 8229, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8252, 8253, 8254, 8255, 8256, 8257, 8258, 8259, 8260, 8261, 8262, 8263, 8264, 8265, 8266, 8267, 8268, 8269, 8270, 8271, 8272, 8273, 8274, 8275, 8276, 8277, 8278, 8279, 8280, 8281, 8282, 8283, 8284, 8285, 8286, 8287, 8288, 8289, 8290, 8291, 8292, 8293, 8294, 8295, 8296, 8297, 8298, 8299, 8300, 8301, 8302, 8303, 8304, 8305, 8306, 8307, 8308, 8309, 8310, 8311, 8312, 8313, 8314, 8315, 8316, 8317, 8318, 8319, 8320, 8321, 8322, 8323, 8324, 8325, 8326, 8327, 8328, 8329, 8330, 8331, 8332, 8333, 8334, 8335, 8336, 8337, 8338, 8339, 8340, 8341, 8342, 8343, 8344, 8345, 8346, 8347, 8348, 8349, 8350, 8351, 8352, 8353, 8354, 8355, 8356, 8357, 8358, 8359, 8360, 8361, 8362, 8363, 8364, 8365, 8366, 8367, 8368, 8369, 8370, 8371, 8372, 8373, 8374, 8375, 8376, 8377, 8378, 8379, 8380, 8381, 8382, 8383, 8384, 8385, 8386, 8387, 8388, 8389, 8390, 8391, 8392, 8393, 8394, 8395, 8396, 8397, 8398, 8399, 8400, 8401, 8402, 8403, 8404, 8405, 8406, 8407, 8408, 8409, 8410, 8411, 8412, 8413, 8414, 8415, 8416, 8417, 8418, 8419, 8420, 8421, 8422, 8423, 8424, 8425, 8426, 8427, 8428, 8429, 8430, 8431, 8432, 8433, 8434, 8435, 8436, 8437, 8438, 8439, 8440, 8441, 8442, 8443, 8444, 8445, 8446, 8447, 8448, 8449, 8450, 8451, 8452, 8453, 8454, 8455, 8456, 8457, 8458, 8459, 8460, 8461, 8462, 8463, 8464, 8465, 8466, 8467, 8468, 8469, 8470, 8471, 8472, 8473, 8474, 8475, 8476, 8477, 8478, 8479, 8480, 8481, 8482, 8483, 8484, 8485, 8486, 8487, 8488, 8489, 8490, 8491, 8492, 8493, 8494, 8495, 8496, 8497, 8498, 8499, 8500, 8501, 8502, 8503, 8504, 8505, 8506, 8507, 8508, 8509, 8510, 8511, 8512, 8513, 8514, 8515, 8516, 8517, 8518, 8519, 8520, 8521, 8522, 8523, 8524, 8525, 8526, 8527, 8528, 8529, 8530, 8531, 8532, 8533, 8534, 8535, 8536, 8537, 8538, 8539, 8540, 8541, 8542, 8543, 8544, 8545, 8546, 8547, 8548, 8549, 8550, 8551, 8552, 8553, 8554, 8555, 8556, 8557, 8558, 8559, 8560, 8561, 8562, 8563, 8564, 8565, 8566, 8567, 8568, 8569, 8570, 8571, 8572, 8573, 8574, 8575, 8576, 8577, 8578, 8579, 8580, 8581, 8582, 8583, 8584, 8585, 8586, 8587, 8588, 8589, 8590, 8591, 8592, 8593, 8594, 8595, 8596, 8597, 8598, 8599, 8600, 8601, 8602, 8603, 8604, 8605, 8606, 8607, 8608, 8609, 8610, 8611, 8612, 8613, 8614, 8615, 8616, 8617, 8618, 8619, 8620, 8621, 8622, 8623, 8624, 8625, 8626, 8627, 8628, 8629, 8630, 8631, 8632, 8633, 8634, 8635, 8636, 8637, 8638, 8639, 8640, 8641, 8642, 8643, 8644, 8645, 8646, 8647, 8648, 8649, 8650, 8651, 8652, 8653, 8654, 8655, 8656, 8657, 8658, 8659, 8660, 8661, 8662, 8663, 8664, 8665, 8666, 8667, 8668, 8669, 8670, 8671, 8672, 8673, 8674, 8675, 8676, 8677, 8678, 8679, 8680, 8681, 8682, 8683, 8684, 8685, 8686, 8687, 8688, 8689, 8690, 8691, 8692, 8693, 8694, 8695, 8696, 8697, 8698, 8699, 8700, 8701, 8702, 8703, 8704, 8705, 8706, 8707, 8708, 8709, 8710, 8711, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8735, 8736, 8737, 8738, 8739, 8740, 8741, 8742, 8743, 8744, 8745, 8746, 8747, 8748, 8749, 8750, 8751, 8752, 8753, 8754, 8755, 8756, 8757, 8758, 8759, 8760, 8761, 8762, 8763, 8764, 8765, 8766, 8767, 8768, 8769, 8770, 8771, 8772, 8773, 8774, 8775, 8776, 8777, 8778, 8779, 8780, 8781, 8782, 8783, 8784, 8785, 8786, 8787, 8788, 8789, 8790, 8791, 8792, 8793, 8794, 8795, 8796, 8797, 8798, 8799, 8800, 8801, 8802, 8803, 8804, 8805, 8806, 8807, 8808, 8809, 8810, 8811, 8812, 8813, 8814, 8815, 8816, 8817, 8818, 8819, 8820, 8821, 8822, 8823, 8824, 8825, 8826, 8827, 8828, 8829, 8830, 8831, 8832, 8833, 8834, 8835, 8836, 8837, 8838, 8839, 8840, 8841, 8842, 8843, 8844, 8845, 8846, 8847, 8848, 8849, 8850, 8851, 8852, 8853, 8854, 8855, 8856, 8857, 8858, 8859, 8860, 8861, 8862, 8863, 8864, 8865, 8866, 8867, 8868, 8869, 8870, 8871, 8872, 8873, 8874, 8875, 8876, 8877, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8905, 8906, 8907, 8908, 8909, 8910, 8911, 8912, 8913, 8914, 8915, 8916, 8917, 8918, 8919, 8920, 8921, 8922, 8923, 8924, 8925, 8926, 8927, 8928, 8929, 8930, 8931, 8932, 8933, 8934, 8935, 8936, 8937, 8938, 8939, 8940, 8941, 8942, 8943, 8944, 8945, 8946, 8947, 8948, 8949, 8950, 8951, 8952, 8953, 8954, 8955, 8956, 8957, 8958, 8959, 8960, 8961, 8962, 8963, 8964, 8965, 8966, 8967, 8968, 8969, 8970, 8971, 8972, 8973, 8974, 8975, 8976, 8977, 8978, 8979, 8980, 8981, 8982, 8983, 8984, 8985, 8986, 8987, 8988, 8989, 8990, 8991, 8992, 8993, 8994, 8995, 8996, 8997, 8998, 8999, 9000, 9001, 9002, 9003, 9004, 9005, 9006, 9007, 9008, 9009, 9010, 9011, 9012, 9013, 9014, 9015, 9016, 9017, 9018, 9019, 9020, 9021, 9022, 9023, 9024, 9025, 9026, 9027, 9028, 9029, 9030, 9031, 9032, 9033, 9034, 9035, 9036, 9037, 9038, 9039, 9040, 9041, 9042, 9043, 9044, 9045, 9046, 9047, 9048, 9049, 9050, 9051, 9052, 9053, 9054, 9055, 9056, 9057, 9058, 9059, 9060, 9061, 9062, 9063, 9064, 9065, 9066, 9067, 9068, 9069, 9070, 9071, 9072, 9073, 9074, 9075, 9076, 9077, 9078, 9079, 9080, 9081, 9082, 9083, 9084, 9085, 9086, 9087, 9088, 9089, 9090, 9091, 9092, 9093, 9094, 9095, 9096, 9097, 9098, 9099, 9100, 9101, 9102, 9103, 9104, 9105, 9106, 9107, 9108, 9109, 9110, 9111, 9112, 9113, 9114, 9115, 9116, 9117, 9118, 9119, 9120, 9121, 9122, 9123, 9124, 9125, 9126, 9127, 9128, 9129, 9130, 9131, 9132, 9133, 9134, 9135, 9136, 9137, 9138, 9139, 9140, 9141, 9142, 9143, 9144, 9145, 9146, 9147, 9148, 9149, 9150, 9151, 9152, 9153, 9154, 9155, 9156, 9157, 9158, 9159, 9160, 9161, 9162, 9163, 9164, 9165, 9166, 9167, 9168, 9169, 9170, 9171, 9172, 9173, 9174, 9175, 9176, 9177, 9178, 9179, 9180, 9181, 9182, 9183, 9184, 9185, 9186, 9187, 9188, 9189, 9190, 9191, 9192, 9193, 9194, 9195, 9196, 9197, 9198, 9199, 9200, 9201, 9202, 9203.

Leukemia

Leukemia is a form of cancer that starts in blood-forming tissue such as the bone marrow which can cause a large number of blood cells to be produced and enter the blood stream. Leukemia can also spread to the central nervous system and cause brain and spinal cord cancer. Types of leukemia include, but are not limited to, adult acute lymphoblastic, childhood acute lymphoblastic, aduct acute myeloid, chronic lymphocytic, chronic myelogenous and hairy cell. Non-limiting examples of symptoms of leukemia include weakness or feeling tired, fever, easy bruising or bleeding, petechiae, shortness of breath, weight loss or loss of appetite, pain in the bones or stomach, pain or feeling of fullness below the ribs, and painless lumps in the neck, underarm, stomach or groin.

In one embodiment, the oncology-related polynucleotides, oncology-related primary constructs or oncology-related mmRNA of the present invention may be used to treat a disease, disorder and/or condition in a subject who has been diagnosed or may be diagnosed with leukemia by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with leukemia by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with leukemia by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4846, 4854, 4855, 4856, 4857, 4858, 4859, 4860, 4861, 4863, 4864, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5093, 5094, 5095, 5096, 5097, 5098, 5099, 5100, 5103, 5104, 5105, 5106, 5107, 5108, 5109, 5110, 5111, 5112, 5113, 5114, 5115, 5116, 5117, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5179, 5180, 5181, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5216, 5217, 5218, 5219, 5220, 5221, 5222, 5223, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5425, 5426, 5427, 5428, 5429, 5438, 5439, 5440, 5441, 5442, 5443, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5574, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5627, 5628, 5629, 5630, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5806, 5807, 5808, 5809, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5923, 5924, 5925, 5926, 5927, 5928, 5929, 5950, 5951, 5952, 5953, 5954, 5955, 5956, 5963, 5967, 5969, 5970, 5971, 5972, 5973, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6196, 6197, 6198, 6199, 6200, 6201, 6202, 6203, 6204, 6205, 6206, 6207, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6318, 6319, 6320, 6321, 6322, 6323, 6324, 6325, 6326, 6356, 6357, 6358, 6378, 6379, 6383, 6384, 6385, 6386, 6387, 6388, 6389, 6390, 6391, 6392, 6393, 6394, 6395, 6396, 6397, 6398, 6399, 6400, 6401, 6402, 6403, 6405, 6406, 6407, 6422, 6423, 6424, 6425, 6426, 6427, 6451, 6452, 6453, 6497, 6498, 6499, 6500, 6501, 6502, 6503, 6509, 6510, 6511, 6512, 6514, 6519, 6520, 6521, 6522, 6523, 6533, 6534, 6535, 6536, 6537, 6538, 6539, 6540, 6541, 6542, 6543, 6544, 6545, 6546, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6665, 6666, 6667, 6668, 6669, 6670, 6675, 6676, 6677, 6678, 6679, 6680, 6681, 6682, 6683, 6684, 6685, 6686, 6688, 6689, 6697, 6698, 6699, 6700, 6701, 6713, 6714, 6715, 6717, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6827, 6828, 6829, 6830, 6831, 6832, 6833, 6834, 6838, 6847, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6956, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7437, 7438, 7458, 7459, 7460, 7461, 7467, 7468, 7469, 7470, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7823, 7824, 7825, 7826, 7827, 7828, 7829, 7830, 7831, 7832, 7833, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8151, 8152, 8153, 8154, 8155, 8156, 8157, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8202, 8203, 8204, 8205, 8206, 8207, 8208, 8209, 8210, 8211, 8212, 8215, 8221, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8264, 8265, 8266, 8267, 8268, 8269, 8270, 8271, 8272, 8273, 8274, 8275, 8276, 8277, 8278, 8279, 8280, 8281, 8282, 8283, 8284, 8299, 8302, 8303, 8304, 8305, 8306, 8315, 8316, 8317, 8353, 8354, 8355, 8356, 8357, 8358, 8359, 8360, 8361, 8375, 8376, 8377, 8378, 8379, 8380, 8381, 8382, 8383, 8384, 8385, 8386, 8387, 8388, 8389, 8390, 8391, 8392, 8393, 8394, 8397, 8398, 8399, 8400, 8401, 8402, 8403, 8404, 8405, 8406, 8410, 8411, 8412, 8419, 8420, 8421, 8422, 8423, 8424, 8425, 8426, 8440, 8459, 8460, 8461, 8462, 8463, 8473, 8474, 8475, 8476, 8477, 8478, 8508, 8509, 8510, 8511, 8512, 8514, 8515, 8533, 8534, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8582, 8586, 8587, 8593, 8594, 8595, 8596, 8597, 8601, 8602, 8603, 8604, 8605, 8610, 8611, 8612, 8613, 8614, 8615, 8617, 8618, 8641, 8642, 8643, 8644, 8645, 8646, 8647, 8648, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9089, 9090, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9202, 9203.

Liver Cancer

There are two types of liver cancer, primary liver cancer which forms in the tissue of the liver and secondary liver cancer, or metastatic liver cancer, that spreads to the liver from another part of the body. Possible symptoms of liver canver include, but are not limited to, a hard lump on the right side just below the rib cage, discomfort in the upper abdomen on the right side, pain around the right shoulder blade, unexplained weight loss, jaundice, unusual tiredness, nausea and loss of appetite.

In one embodiment, the oncology-related polynucleotides, oncology-related primary constructs or oncology-related mmRNA of the present invention may be used to treat a disease, disorder and/or condition in a subject who has been diagnosed or may be diagnosed with liver cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with liver cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with liver cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4774, 4775, 4781, 4782, 4783, 4784, 4785, 4786, 4787, 4788, 4789, 4790, 4825, 4826, 4827, 4828, 4829, 4830, 4832, 4844, 4845, 4846, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5575, 5576, 5577, 5578, 5579, 5580, 5590, 5591, 5592, 5593, 5594, 5595, 5596, 5597, 5598, 5599, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5742, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5842, 5843, 5844, 5845, 5846, 5847, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5968, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6291, 6292, 6293, 6294, 6295, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6380, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6559, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6697, 6698, 6699, 6700, 6701, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6844, 6845, 6846, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6961, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7492, 7493, 7494, 7495, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7577, 7578, 7579, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8146, 8147, 8148, 8149, 8150, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8464, 8465, 8466, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8583, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8735, 8736, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9067, 9068, 9069, 9070, 9071, 9072, 9073, 9074, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9153, 9154, 9155, 9156, 9157, 9158, 9159, 9160, 9161, 9162, 9163, 9201, 9203.

Lung Cancer

Lung cancer forms in the tissues of the lung usually in the cells lining the air passages and is classified as either small cell lung cancer or non-small cell lung cancer. There are two types of small cell lung cancer, small cell carcinoma and combined small cell carcinoma. The types of on-small cell lung cancer are squamous cell carcinoma (cancer begins in the squamous cells), large cell carcinoma (cancer may begin in several types of cells) and adenocarcinoma (cancer begins in the cells that line the alveoli and in cells that make mucus). Symptoms of lung cancer include, but are not limited to, chest discomfort or pain, cough that does not go away or gets worse over time, trouble breathing, wheezing, blood in the sputum, hoarseness, loss of appetite, weight loss for no known reason, feeling very tired, trouble swallowing and swelling in the face and/or veins in the neck.

In one embodiment, the oncology-related polynucleotides, oncology-related primary constructs or oncology-related mmRNA of the present invention may be used to treat a disease, disorder and/or condition in a subject who has been diagnosed or may be diagnosed with lung cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with lung cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with lung cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4791, 4797, 4798, 4799, 4800, 4801, 4802, 4803, 4804, 4805, 4806, 4807, 4808, 4825, 4826, 4827, 4828, 4829, 4830, 4831, 4832, 4851, 4852, 4853, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5282, 5283, 5286, 5287, 5288, 5289, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5582, 5583, 5584, 5585, 5586, 5587, 5590, 5591, 5592, 5593, 5594, 5595, 5596, 5600, 5601, 5602, 5603, 5604, 5605, 5606, 5607, 5608, 5609, 5610, 5611, 5616, 5617, 5618, 5619, 5620, 5621, 5622, 5623, 5624, 5625, 5626, 5631, 5632, 5633, 5638, 5639, 5640, 5648, 5649, 5650, 5651, 5652, 5653, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5804, 5805, 5806, 5807, 5808, 5809, 5810, 5815, 5816, 5817, 5821, 5822, 5823, 5824, 5825, 5826, 5827, 5828, 5829, 5830, 5831, 5833, 5834, 5836, 5837, 5838, 5839, 5840, 5841, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5906, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5964, 5965, 5966, 5967, 5969, 5970, 5982, 5983, 5984, 5985, 5986, 5987, 5988, 5997, 5998, 5999, 6000, 6001, 6002, 6029, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6188, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6360, 6361, 6362, 6363, 6364, 6375, 6376, 6377, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6513, 6514, 6515, 6516, 6517, 6518, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6645, 6646, 6684, 6685, 6686, 6697, 6698, 6699, 6700, 6701, 6719, 6720, 6721, 6723, 6724, 6754, 6755, 6756, 6757, 6758, 6759, 6760, 6761, 6762, 6763, 6764, 6796, 6797, 6798, 6799, 6800, 6802, 6803, 6805, 6806, 6807, 6808, 6809, 6814, 6815, 6816, 6817, 6818, 6824, 6825, 6826, 6831, 6832, 6833, 6834, 6839, 6840, 6841, 6842, 6843, 6853, 6854, 6855, 6856, 6857, 6860, 6861, 6862, 6863, 6864, 6865, 6866, 6867, 6868, 6869, 6872, 6873, 6874, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6974, 6975, 6976, 6977, 6978, 6979, 6980, 6981, 6982, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7085, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7299, 7300, 7301, 7302, 7303, 7304, 7347, 7348, 7349, 7350, 7351, 7352, 7353, 7354, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7516, 7517, 7518, 7519, 7520, 7521, 7522, 7523, 7524, 7525, 7526, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7881, 7886, 7887, 7888, 7889, 7890, 7891, 7892, 7893, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8093, 8094, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8307, 8308, 8326, 8353, 8354, 8355, 8356, 8357, 8358, 8359, 8360, 8361, 8375, 8376, 8377, 8378, 8379, 8380, 8381, 8382, 8407, 8408, 8409, 8410, 8411, 8412, 8440, 8459, 8460, 8461, 8462, 8463, 8467, 8468, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8598, 8599, 8600, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8768, 8769, 8770, 8771, 8772, 8773, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Lymphoma

Lymphoma is cancer that beings in the cells of the immune system. Subjects who have Hodgkin lymphoma have a cell called Reed-Sternberg cell and non-Hodgkin lymphoma includes a large group of cancers of immune system cells. Examples of Lymphoma include, but are not limited to, painless, swollen lymph nodes in the neck, underarm or groin, fever for no known reason, drenching night sweats, weight loss for no known reason, itchy skin and fatigue.

In one embodiment, the oncology-related polynucleotides, oncology-related primary constructs or oncology-related mmRNA of the present invention may be used to treat a disease, disorder and/or condition in a subject who has been diagnosed or may be diagnosed with lymphoma by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with lymphoma by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with lymphoma by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4809, 4810, 4811, 4812, 4813, 4814, 4825, 4826, 4827, 4828, 4829, 4830, 4832, 4833, 4834, 4850, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5003, 5004, 5005, 5006, 5007, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5430, 5431, 5432, 5433, 5434, 5435, 5436, 5437, 5438, 5439, 5440, 5441, 5442, 5443, 5444, 5445, 5446, 5447, 5448, 5449, 5450, 5451, 5452, 5453, 5454, 5455, 5456, 5457, 5458, 5459, 5460, 5461, 5462, 5463, 5464, 5465, 5466, 5467, 5468, 5469, 5470, 5471, 5472, 5473, 5474, 5475, 5476, 5477, 5478, 5479, 5480, 5481, 5482, 5483, 5484, 5485, 5486, 5487, 5488, 5489, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5612, 5613, 5614, 5615, 5616, 5617, 5618, 5619, 5620, 5621, 5622, 5623, 5631, 5632, 5633, 5638, 5639, 5640, 5666, 5667, 5668, 5669, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5804, 5805, 5806, 5807, 5808, 5809, 5810, 5811, 5812, 5813, 5814, 5815, 5816, 5817, 5818, 5819, 5820, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5900, 5901, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6192, 6193, 6194, 6195, 6208, 6209, 6231, 6232, 6233, 6234, 6235, 6236, 6237, 6238, 6239, 6251, 6256, 6257, 6258, 6259, 6260, 6261, 6262, 6271, 6272, 6273, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6687, 6697, 6698, 6699, 6700, 6701, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6835, 6836, 6837, 6848, 6849, 6850, 6851, 6852, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6937, 6938, 6939, 6940, 6941, 6942, 6943, 6944, 6945, 6946, 6947, 6948, 6949, 6950, 6951, 6952, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7199, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7287, 7288, 7289, 7291, 7292, 7293, 7294, 7295, 7296, 7297, 7298, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7571, 7572, 7573, 7574, 7575, 7576, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7677, 7685, 7687, 7689, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7920, 7921, 7925, 7926, 7927, 7928, 7929, 7930, 7931, 7932, 7933, 7934, 7935, 7936, 7937, 7938, 7939, 7940, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8189, 8190, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8414, 8415, 8416, 8417, 8418, 8440, 8459, 8460, 8461, 8462, 8463, 8474, 8475, 8476, 8477, 8478, 8487, 8488, 8489, 8490, 8491, 8492, 8493, 8494, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8652, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8737, 8738, 8739, 8740, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8869, 8870, 8871, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9015, 9016, 9017, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Ovarian Cancer

Ovarian cancer is cancer which forms in the tissues of the ovary which are either ovarian epithelial carcinomas (begins on the surface of the ovary) or malignant germ cell tumors (cancer that begins in the egg cells). Symptoms of ovarian cancer include, but are not limited to, pain or swelling in the abdomen, pain in the pelvis, gastrointestinal problems such as gas, bloating, or constipation and vaginal bleeding after menopause.

In one embodiment, the oncology-related polynucleotides, oncology-related primary constructs or oncology-related mmRNA of the present invention may be used to treat a disease, disorder and/or condition in a subject who has been diagnosed or may be diagnosed with ovarian cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with ovarian cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with ovarian cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6697, 6698, 6699, 6700, 6701, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8852, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Prostate Cancer

Prostate that forms in the tissue of the prostate mainly affects older men. Non-limiting examples of prostate cancer include, but are not limited to, weak or interrupted flow of urine, frequent urination, trouble urinating, pain or burning during urination, blood in the urine or semen, pain in the back, hips or pelvis that does not go away and painful ejaculation.

In one embodiment, the oncology-related polynucleotides, oncology-related primary constructs or oncology-related mmRNA of the present invention may be used to treat a disease, disorder and/or condition in a subject who has been diagnosed or may be diagnosed with prostate cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with prostate cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with prostate cancer by administering to said subject an isolated polynucleotide encoding an oncology-related polypeptide of interest. In a further embodiment, the oncology-related polypeptide of interest may include, but not limited to, SEQ ID NOs: 4704, 4705, 4706, 4707, 4708, 4709, 4710, 4711, 4712, 4713, 4714, 4715, 4716, 4717, 4718, 4719, 4720, 4721, 4722, 4723, 4724, 4725, 4726, 4727, 4728, 4729, 4730, 4731, 4732, 4733, 4734, 4735, 4736, 4737, 4738, 4739, 4740, 4741, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4835, 4836, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4895, 4896, 4897, 4898, 4899, 4900, 4901, 4902, 4903, 4904, 4905, 4906, 4907, 4908, 4909, 4910, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5233, 5234, 5235, 5236, 5249, 5250, 5251, 5252, 5253, 5254, 5255, 5256, 5257, 5258, 5259, 5260, 5261, 5262, 5263, 5264, 5265, 5266, 5267, 5268, 5269, 5270, 5271, 5272, 5273, 5274, 5275, 5276, 5277, 5278, 5279, 5280, 5281, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5419, 5420, 5421, 5422, 5423, 5424, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5537, 5538, 5539, 5540, 5541, 5542, 5543, 5544, 5545, 5546, 5547, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5682, 5683, 5684, 5685, 5686, 5687, 5688, 5689, 5690, 5691, 5692, 5693, 5694, 5695, 5696, 5697, 5698, 5699, 5700, 5701, 5702, 5703, 5704, 5705, 5706, 5707, 5708, 5709, 5710, 5711, 5712, 5713, 5714, 5715, 5716, 5717, 5727, 5740, 5741, 5742, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5856, 5857, 5858, 5859, 5860, 5861, 5862, 5863, 5864, 5865, 5866, 5867, 5868, 5869, 5870, 5871, 5872, 5873, 5874, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5974, 5975, 5976, 5977, 5978, 5979, 5980, 5981, 5982, 5983, 5984, 5985, 5986, 5987, 5988, 5994, 5995, 5996, 5997, 5998, 5999, 6000, 6001, 6002, 6020, 6021, 6022, 6023, 6024, 6025, 6026, 6027, 6028, 6056, 6057, 6058, 6059, 6060, 6061, 6062, 6063, 6064, 6065, 6066, 6067, 6068, 6069, 6070, 6071, 6072, 6073, 6074, 6075, 6076, 6077, 6078, 6079, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6150, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6189, 6190, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6346, 6347, 6356, 6357, 6358, 6365, 6366, 6367, 6368, 6369, 6370, 6372, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6446, 6447, 6448, 6451, 6452, 6453, 6497, 6498, 6499, 6500, 6501, 6502, 6503, 6504, 6505, 6506, 6507, 6508, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6591, 6592, 6593, 6594, 6595, 6596, 6597, 6598, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6684, 6685, 6686, 6697, 6698, 6699, 6700, 6701, 6716, 6719, 6721, 6723, 6724, 6725, 6726, 6727, 6728, 6729, 6730, 6731, 6732, 6733, 6734, 6735, 6754, 6755, 6756, 6757, 6758, 6759, 6760, 6761, 6762, 6763, 6764, 6796, 6797, 6798, 6799, 6800, 6801, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6858, 6859, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6986, 6987, 6988, 6989, 6990, 6991, 6992, 6993, 6994, 6995, 7007, 7008, 7009, 7010, 7011, 7012, 7015, 7016, 7017, 7018, 7019, 7020, 7021, 7022, 7023, 7024, 7025, 7026, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7183, 7184, 7185, 7186, 7188, 7189, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7272, 7273, 7274, 7275, 7291, 7292, 7293, 7294, 7295, 7296, 7297, 7298, 7347, 7348, 7349, 7355, 7356, 7357, 7358, 7359, 7360, 7361, 7362, 7363, 7364, 7365, 7372, 7373, 7374, 7375, 7376, 7377, 7378, 7383, 7415, 7416, 7417, 7438, 7439, 7440, 7441, 7442, 7471, 7472, 7473, 7474, 7475, 7476, 7477, 7478, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7561, 7562, 7563, 7564, 7565, 7566, 7567, 7568, 7569, 7570, 7581, 7582, 7583, 7584, 7585, 7586, 7587, 7588, 7589, 7590, 7591, 7592, 7593, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7871, 7872, 7873, 7874, 7875, 7876, 7877, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8252, 8253, 8254, 8255, 8256, 8257, 8258, 8259, 8260, 8261, 8262, 8263, 8299, 8302, 8303, 8304, 8305, 8306, 8334, 8335, 8336, 8337, 8338, 8339, 8340, 8341, 8342, 8343, 8344, 8353, 8354, 8355, 8356, 8357, 8358, 8359, 8360, 8361, 8365, 8366, 8367, 8368, 8369, 8370, 8371, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8501, 8502, 8503, 8507, 8508, 8509, 8510, 8511, 8512, 8514, 8515, 8537, 8538, 8539, 8544, 8545, 8546, 8547, 8548, 8549, 8550, 8551, 8552, 8553, 8554, 8555, 8558, 8559, 8560, 8561, 8562, 8563, 8564, 8565, 8566, 8567, 8570, 8571, 8572, 8573, 8574, 8575, 8576, 8577, 8578, 8579, 8580, 8581, 8586, 8587, 8588, 8589, 8590, 8591, 8592, 8593, 8594, 8595, 8596, 8597, 8601, 8602, 8603, 8604, 8605, 8615, 8617, 8618, 8655, 8686, 8693, 8694, 8695, 8696, 8697, 8698, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8807, 8808, 8809, 8810, 8811, 8817, 8818, 8819, 8820, 8821, 8822, 8823, 8824, 8825, 8826, 8827, 8828, 8829, 8830, 8837, 8838, 8839, 8840, 8841, 8842, 8843, 8844, 8845, 8846, 8847, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8877, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8923, 8924, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8974, 8975, 8976, 8977, 8978, 8979, 8980, 8981, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9111, 9112, 9113, 9114, 9115, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9186, 9187, 9188, 9189, 9190, 9191, 9192, 9193, 9194, 9195, 9196, 9197, 9198, 9199, 9200, 9201, 9203.

Testicular Cancer

Testicular cancer forms in the tissues of one or both testicles and is most common in young or middle-aged men. Most testicular cancers being in germ cells and are called testicular germ cell tumors. There are two types of testicular germ cell tumors called seminomas and nonseminomas. Common symptoms of testicular cancer include, but are not limited to, a painless lump or swelling in either testicle, change in how the testicle feels, dull ache in the lower abdomen or the groin, sudden build-up of fluid in the scrotum and pain or discomfort in a testicle or in the scrotum.

In one embodiment, the oncology-related polynucleotides, oncology-related primary constructs or oncology-related mmRNA of the present invention may be used to treat a disease, disorder and/or condition in a subject who has been diagnosed or may be diagnosed with testicular cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with testicular cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with testicular cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6658, 6684, 6685, 6686, 6697, 6698, 6699, 6700, 6701, 6702, 6703, 6704, 6705, 6706, 6707, 6708, 6709, 6710, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7305, 7306, 7307, 7308, 7309, 7310, 7311, 7312, 7313, 7314, 7315, 7316, 7317, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7594, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Throat Cancer

Throat cancer forms in the tissues of the pharynx and includes cancer of the nasopharynx (nasopharyngeal cancer), oropharynx (oropharyngeal cancer), hypopharynx (hypopharyngeal cancer), and larynx (laryngeal cancer). Common symptoms of throat cancer include, but are not limited to, a sore throat that does not go away, ear pain, lump in the neck, painful or difficulty swallowing, change or hoarseness in the voice, trouble breathing or speaking, nosebleeds, trouble hearing, pain or ringing in the ear, headaches, dull pain behind the breast bone, cough and weight loss for no reason.

In one embodiment, the oncology-related polynucleotides, oncology-related primary constructs or oncology-related mmRNA of the present invention may be used to treat a disease, disorder and/or condition in a subject who has been diagnosed or may be diagnosed with throat cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce, eliminate, or prevent tumor growth in a subject who has been diagnosed or may be diagnosed with throat cancer by administering to said subject an isolated polynucleotide encoding an oncology-related polypeptide of interest. In one embodiment, the oncology-related polynucleotides, oncology-related primary constructs or oncology-related mmRNA of the present invention may be used to reduce and/or ameliorate at least one symptom of cancer in a subject who has been diagnosed or may be diagnosed with throat cancer by administering to said subject an isolated polynucleotide encoding an oncology-related polypeptide of interest. In a further embodiment, the oncology-related polypeptide of interest may include, but not limited to, SEQ ID NOs: 4711, 4712, 4713, 4714, 4715, 4716, 4717, 4718, 4719, 4720, 4721, 4722, 4723, 4724, 4725, 4726, 4727, 4728, 4742, 4743, 4744, 4745, 4746, 4747, 4748, 4749, 4750, 4751, 4781, 4782, 4783, 4784, 4785, 4786, 4787, 4788, 4789, 4790, 4825, 4826, 4827, 4828, 4829, 4830, 4832, 4854, 4855, 4856, 4857, 4858, 4859, 4860, 4861, 4863, 4864, 4865, 4866, 4867, 4868, 4869, 4870, 4871, 4872, 4873, 4885, 4886, 4887, 4888, 4889, 4890, 4891, 4892, 4893, 4894, 4911, 4912, 4913, 4914, 4915, 4916, 4917, 4918, 4919, 4920, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5008, 5009, 5010, 5011, 5012, 5013, 5014, 5015, 5016, 5017, 5018, 5019, 5020, 5021, 5022, 5023, 5024, 5025, 5026, 5027, 5028, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5103, 5104, 5105, 5106, 5107, 5108, 5109, 5110, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5230, 5231, 5252, 5253, 5254, 5255, 5256, 5257, 5258, 5259, 5260, 5261, 5262, 5263, 5264, 5265, 5266, 5267, 5268, 5269, 5270, 5271, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5419, 5420, 5421, 5426, 5427, 5428, 5429, 5438, 5447, 5448, 5449, 5450, 5451, 5452, 5453, 5454, 5455, 5456, 5457, 5458, 5459, 5460, 5461, 5462, 5463, 5464, 5465, 5469, 5470, 5477, 5478, 5479, 5480, 5481, 5482, 5490, 5491, 5492, 5493, 5494, 5495, 5496, 5497, 5498, 5499, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5548, 5549, 5551, 5552, 5553, 5554, 5555, 5556, 5557, 5558, 5559, 5560, 5561, 5562, 5563, 5564, 5565, 5566, 5567, 5568, 5569, 5570, 5571, 5577, 5578, 5579, 5580, 5590, 5591, 5592, 5593, 5594, 5595, 5596, 5605, 5606, 5607, 5608, 5609, 5610, 5611, 5616, 5617, 5618, 5619, 5620, 5621, 5622, 5623, 5631, 5632, 5633, 5638, 5639, 5640, 5671, 5672, 5673, 5674, 5675, 5676, 5677, 5678, 5679, 5680, 5681, 5688, 5689, 5690, 5691, 5692, 5693, 5694, 5695, 5696, 5697, 5698, 5699, 5700, 5701, 5702, 5703, 5708, 5709, 5710, 5711, 5712, 5713, 5714, 5715, 5716, 5717, 5727, 5740, 5741, 5743, 5744, 5745, 5746, 5747, 5748, 5749, 5750, 5751, 5755, 5757, 5758, 5759, 5760, 5761, 5762, 5763, 5764, 5765, 5766, 5767, 5768, 5769, 5770, 5772, 5773, 5775, 5776, 5777, 5778, 5779, 5780, 5783, 5784, 5785, 5786, 5787, 5788, 5789, 5790, 5791, 5792, 5793, 5794, 5795, 5796, 5797, 5798, 5799, 5800, 5801, 5802, 5803, 5811, 5812, 5813, 5814, 5821, 5822, 5823, 5824, 5825, 5826, 5827, 5828, 5829, 5830, 5831, 5833, 5834, 5836, 5837, 5838, 5839, 5848, 5849, 5850, 5851, 5852, 5853, 5854, 5855, 5864, 5865, 5866, 5867, 5868, 5875, 5876, 5877, 5878, 5880, 5881, 5882, 5883, 5884, 5885, 5886, 5887, 5888, 5889, 5890, 5891, 5892, 5893, 5894, 5895, 5896, 5897, 5898, 5899, 5907, 5908, 5909, 5911, 5912, 5913, 5914, 5915, 5916, 5917, 5918, 5919, 5920, 5921, 5922, 5929, 5950, 5951, 5952, 5953, 5954, 5955, 5956, 5963, 5967, 5969, 5970, 5982, 5983, 5984, 5985, 5986, 5987, 5988, 5997, 5998, 5999, 6000, 6001, 6002, 6068, 6069, 6070, 6071, 6072, 6074, 6075, 6076, 6077, 6078, 6080, 6081, 6082, 6083, 6084, 6085, 6086, 6087, 6088, 6089, 6090, 6091, 6092, 6093, 6094, 6095, 6096, 6097, 6098, 6100, 6101, 6102, 6103, 6105, 6106, 6107, 6108, 6109, 6110, 6111, 6112, 6113, 6114, 6115, 6116, 6117, 6118, 6119, 6120, 6121, 6122, 6123, 6124, 6128, 6130, 6142, 6143, 6144, 6145, 6146, 6147, 6148, 6149, 6151, 6152, 6153, 6154, 6155, 6156, 6157, 6169, 6170, 6171, 6172, 6173, 6174, 6175, 6176, 6177, 6178, 6179, 6180, 6181, 6182, 6185, 6186, 6187, 6191, 6208, 6209, 6231, 6232, 6233, 6234, 6235, 6236, 6237, 6238, 6239, 6251, 6256, 6257, 6258, 6259, 6260, 6261, 6262, 6278, 6279, 6280, 6281, 6282, 6286, 6287, 6288, 6289, 6290, 6298, 6299, 6300, 6301, 6302, 6303, 6304, 6305, 6306, 6307, 6308, 6309, 6310, 6311, 6312, 6313, 6314, 6315, 6356, 6357, 6358, 6378, 6379, 6387, 6388, 6389, 6390, 6391, 6392, 6393, 6394, 6395, 6396, 6397, 6398, 6399, 6400, 6401, 6402, 6403, 6405, 6406, 6407, 6451, 6452, 6453, 6497, 6498, 6499, 6500, 6501, 6502, 6503, 6509, 6510, 6511, 6512, 6514, 6519, 6520, 6521, 6522, 6523, 6549, 6550, 6551, 6552, 6553, 6554, 6555, 6556, 6557, 6558, 6588, 6589, 6599, 6600, 6601, 6602, 6603, 6604, 6605, 6606, 6611, 6612, 6613, 6614, 6615, 6616, 6617, 6618, 6619, 6620, 6621, 6622, 6623, 6624, 6625, 6626, 6627, 6628, 6629, 6630, 6631, 6632, 6633, 6634, 6638, 6639, 6640, 6641, 6642, 6643, 6644, 6658, 6684, 6685, 6686, 6697, 6698, 6699, 6700, 6701, 6702, 6703, 6704, 6705, 6706, 6707, 6708, 6709, 6710, 6719, 6721, 6723, 6724, 6754, 6755, 6756, 6757, 6758, 6759, 6760, 6761, 6762, 6763, 6764, 6796, 6797, 6798, 6799, 6800, 6805, 6806, 6807, 6808, 6809, 6814, 6815, 6816, 6817, 6818, 6824, 6825, 6826, 6831, 6832, 6833, 6834, 6853, 6854, 6855, 6856, 6857, 6860, 6861, 6862, 6863, 6864, 6865, 6866, 6867, 6868, 6869, 6872, 6873, 6875, 6876, 6877, 6878, 6879, 6885, 6888, 6889, 6890, 6891, 6892, 6893, 6894, 6895, 6896, 6897, 6898, 6899, 6900, 6901, 6902, 6903, 6904, 6905, 6906, 6907, 6908, 6909, 6910, 6911, 6912, 6913, 6914, 6915, 6916, 6917, 6918, 6919, 6920, 6921, 6922, 6923, 6924, 6925, 6926, 6927, 6928, 6929, 6930, 6931, 6932, 6933, 6934, 6935, 6936, 6953, 6954, 6955, 6957, 6958, 6959, 6960, 6962, 6963, 6964, 6965, 6966, 6967, 6968, 6969, 6970, 6971, 6972, 6973, 6983, 6984, 6985, 6988, 6989, 6990, 6991, 6992, 6993, 6994, 6995, 7007, 7008, 7009, 7010, 7011, 7012, 7015, 7016, 7017, 7018, 7019, 7020, 7021, 7034, 7035, 7084, 7086, 7087, 7088, 7089, 7090, 7091, 7092, 7128, 7137, 7138, 7139, 7140, 7141, 7142, 7143, 7144, 7145, 7146, 7147, 7148, 7149, 7150, 7151, 7152, 7153, 7154, 7155, 7195, 7196, 7197, 7198, 7200, 7201, 7202, 7203, 7204, 7205, 7206, 7207, 7208, 7209, 7210, 7211, 7212, 7213, 7214, 7215, 7216, 7217, 7218, 7219, 7220, 7221, 7222, 7223, 7224, 7225, 7226, 7227, 7228, 7229, 7230, 7231, 7232, 7233, 7234, 7235, 7236, 7237, 7238, 7239, 7240, 7241, 7243, 7244, 7245, 7246, 7247, 7248, 7249, 7250, 7251, 7252, 7253, 7254, 7255, 7256, 7257, 7258, 7259, 7260, 7261, 7262, 7263, 7264, 7265, 7266, 7267, 7268, 7269, 7270, 7271, 7291, 7292, 7293, 7294, 7295, 7296, 7297, 7298, 7305, 7306, 7307, 7308, 7309, 7310, 7311, 7312, 7313, 7314, 7315, 7316, 7317, 7347, 7348, 7349, 7358, 7359, 7360, 7361, 7362, 7363, 7364, 7365, 7372, 7373, 7374, 7375, 7376, 7377, 7378, 7383, 7415, 7416, 7417, 7438, 7471, 7472, 7473, 7474, 7475, 7476, 7477, 7490, 7496, 7497, 7498, 7499, 7500, 7501, 7502, 7503, 7504, 7505, 7506, 7507, 7508, 7509, 7510, 7511, 7512, 7513, 7514, 7515, 7532, 7533, 7534, 7535, 7537, 7538, 7539, 7540, 7541, 7542, 7543, 7544, 7545, 7546, 7547, 7548, 7549, 7550, 7551, 7552, 7553, 7554, 7555, 7556, 7557, 7558, 7559, 7560, 7585, 7586, 7587, 7588, 7589, 7590, 7591, 7592, 7593, 7594, 7595, 7596, 7597, 7599, 7600, 7601, 7617, 7618, 7619, 7620, 7621, 7622, 7623, 7638, 7668, 7669, 7670, 7672, 7673, 7674, 7675, 7676, 7685, 7687, 7694, 7695, 7696, 7717, 7718, 7719, 7720, 7721, 7722, 7723, 7724, 7725, 7726, 7727, 7728, 7729, 7730, 7731, 7732, 7733, 7734, 7735, 7736, 7737, 7738, 7739, 7740, 7741, 7742, 7743, 7744, 7746, 7747, 7748, 7749, 7750, 7751, 7752, 7757, 7758, 7759, 7760, 7761, 7762, 7763, 7764, 7765, 7766, 7767, 7768, 7796, 7797, 7805, 7813, 7814, 7815, 7816, 7817, 7818, 7819, 7820, 7821, 7822, 7848, 7849, 7850, 7851, 7852, 7853, 7854, 7859, 7860, 7861, 7862, 7863, 7864, 7865, 7866, 7867, 7869, 7870, 7874, 7875, 7917, 7918, 7919, 7925, 7926, 7927, 7928, 7929, 7941, 7942, 7943, 7944, 7945, 7946, 7947, 7948, 7949, 7950, 7951, 7952, 7953, 7955, 7956, 7957, 7958, 7959, 7960, 7961, 7962, 7963, 7964, 7965, 7966, 7967, 7968, 7969, 7970, 7971, 7972, 7974, 7975, 7976, 7977, 7978, 7979, 7980, 7981, 7982, 7983, 7984, 7985, 7986, 7987, 7988, 7989, 7990, 7991, 7992, 7993, 7994, 7995, 7996, 7997, 7998, 7999, 8000, 8011, 8012, 8013, 8014, 8015, 8016, 8017, 8018, 8019, 8020, 8021, 8022, 8023, 8024, 8025, 8026, 8027, 8028, 8029, 8030, 8048, 8049, 8050, 8051, 8052, 8053, 8054, 8055, 8056, 8057, 8087, 8088, 8089, 8090, 8091, 8092, 8095, 8096, 8097, 8098, 8099, 8100, 8101, 8102, 8103, 8104, 8105, 8106, 8107, 8110, 8111, 8112, 8113, 8114, 8115, 8116, 8117, 8118, 8119, 8120, 8121, 8122, 8123, 8124, 8125, 8126, 8127, 8130, 8131, 8132, 8133, 8134, 8135, 8136, 8144, 8145, 8166, 8169, 8170, 8171, 8172, 8173, 8174, 8175, 8176, 8177, 8178, 8179, 8180, 8181, 8182, 8188, 8191, 8192, 8193, 8194, 8195, 8196, 8197, 8198, 8199, 8200, 8201, 8209, 8210, 8211, 8212, 8215, 8227, 8230, 8231, 8232, 8233, 8234, 8235, 8236, 8237, 8238, 8239, 8240, 8241, 8242, 8243, 8244, 8245, 8246, 8247, 8248, 8249, 8250, 8251, 8260, 8261, 8262, 8263, 8299, 8302, 8303, 8304, 8305, 8306, 8353, 8354, 8355, 8356, 8357, 8358, 8359, 8360, 8361, 8375, 8376, 8377, 8378, 8379, 8380, 8381, 8382, 8410, 8411, 8412, 8440, 8459, 8460, 8461, 8462, 8463, 8474, 8475, 8476, 8477, 8478, 8508, 8509, 8510, 8511, 8512, 8514, 8515, 8546, 8547, 8548, 8549, 8550, 8551, 8552, 8553, 8554, 8555, 8570, 8571, 8572, 8573, 8574, 8575, 8576, 8577, 8578, 8579, 8580, 8581, 8586, 8587, 8593, 8594, 8595, 8596, 8597, 8601, 8602, 8603, 8604, 8605, 8615, 8617, 8618, 8655, 8686, 8709, 8712, 8713, 8714, 8715, 8716, 8717, 8718, 8719, 8720, 8721, 8722, 8723, 8724, 8725, 8726, 8727, 8728, 8729, 8730, 8731, 8732, 8733, 8734, 8770, 8771, 8788, 8789, 8790, 8791, 8792, 8793, 8794, 8795, 8796, 8797, 8798, 8799, 8800, 8801, 8802, 8803, 8804, 8805, 8806, 8810, 8811, 8817, 8818, 8819, 8820, 8821, 8822, 8823, 8829, 8830, 8837, 8838, 8839, 8840, 8841, 8848, 8849, 8850, 8851, 8854, 8855, 8856, 8857, 8858, 8859, 8860, 8861, 8862, 8863, 8864, 8865, 8867, 8868, 8872, 8873, 8874, 8875, 8876, 8878, 8879, 8880, 8881, 8882, 8883, 8884, 8885, 8886, 8887, 8888, 8889, 8890, 8891, 8892, 8893, 8894, 8895, 8896, 8897, 8898, 8899, 8900, 8901, 8902, 8903, 8904, 8906, 8913, 8914, 8915, 8916, 8917, 8918, 8919, 8920, 8921, 8925, 8926, 8927, 8928, 8933, 8934, 8935, 8936, 8937, 8938, 8939, 8940, 8941, 8942, 8943, 8944, 8945, 8946, 8947, 8948, 8949, 8950, 8951, 8954, 8955, 8956, 8992, 8993, 8994, 8995, 8996, 8997, 8998, 8999, 9000, 9001, 9002, 9003, 9010, 9011, 9012, 9013, 9014, 9018, 9019, 9020, 9021, 9022, 9023, 9024, 9025, 9026, 9027, 9028, 9029, 9030, 9031, 9041, 9042, 9043, 9044, 9045, 9046, 9047, 9048, 9049, 9050, 9051, 9052, 9053, 9054, 9055, 9056, 9057, 9058, 9059, 9065, 9066, 9087, 9088, 9091, 9092, 9093, 9094, 9095, 9096, 9097, 9098, 9103, 9104, 9105, 9106, 9107, 9108, 9109, 9110, 9123, 9124, 9125, 9126, 9127, 9128, 9129, 9130, 9131, 9133, 9134, 9135, 9136, 9137, 9145, 9146, 9147, 9148, 9149, 9150, 9151, 9160, 9161, 9162, 9163, 9201, 9203.

Avoidance of the Immune Response

As described herein, a useful feature of the oncology-related polynucleotides, primary constructs or mmRNA of the invention is the capacity to reduce, evade or avoid the innate immune response of a cell. In one aspect, provided herein are polynucleotides, primary constructs or mmRNA encoding a polypeptide of interest which when delivered to cells, results in a reduced immune response from the host as compared to the response triggered by a reference compound, e.g. an unmodified polynucleotide corresponding to a polynucleotide, primary construct or mmRNA of the invention, or a different polynucleotide, primary construct or mmRNA of the invention. As used herein, a "reference compound" is any molecule or substance which when administered to a mammal, results in an innate immune response having a known degree, level or amount of immune stimulation. A reference compound need not be a nucleic acid molecule and it need not be any of the oncology-related polynucleotides, primary constructs or mmRNA of the invention. Hence, the measure of a polynucleotides, primary constructs or mmRNA avoidance, evasion or failure to trigger an immune response can be expressed in terms relative to any compound or substance which is known to trigger such a response.

The term "innate immune response" includes a cellular response to exogenous single stranded nucleic acids, generally of viral or bacterial origin, which involves the induction of cytokine expression and release, particularly the interferons, and cell death. As used herein, the innate immune response or interferon response operates at the single cell level causing cytokine expression, cytokine release, global inhibition of protein synthesis, global destruction of cellular RNA, upregulation of major histocompatibility molecules, and/or induction of apoptotic death, induction of gene transcription of genes involved in apoptosis, anti-growth, and innate and adaptive immune cell activation. Some of the genes induced by type I IFNs include PKR, ADAR (adenosine deaminase acting on RNA), OAS (2',5'-oligoadenylate synthetase), RNase L, and Mx proteins. PKR and ADAR lead to inhibition of translation initiation and RNA editing, respectively. OAS is a dsRNA-dependent synthetase that activates the endoribonuclease RNase L to degrade ssRNA.

In some embodiments, the innate immune response comprises expression of a Type I or Type II interferon, and the expression of the Type I or Type II interferon is not increased more than two-fold compared to a reference from a cell which has not been contacted with a polynucleotide, primary construct or mmRNA of the invention.

In some embodiments, the innate immune response comprises expression of one or more IFN signature genes and where the expression of the one of more IFN signature genes is not increased more than three-fold compared to a reference from a cell which has not been contacted with the polynucleotide, primary construct or mmRNA of the invention.

While in some circumstances, it might be advantageous to eliminate the innate immune response in a cell, the invention provides polynucleotides, primary constructs and mmRNA that upon administration result in a substantially reduced (significantly less) the immune response, including interferon signaling, without entirely eliminating such a response.

In some embodiments, the immune response is lower by 10%, 20%, 30%, 40%, 50%, 60%, 70%, 80%, 90%, 95%, 99%, 99.9%, or greater than 99.9% as compared to the immune response induced by a reference compound. The immune response itself may be measured by determining the expression or activity level of Type 1 interferons or the expression of interferon-regulated genes such as the toll-like receptors (e.g., TLR7 and TLR8). Reduction of innate immune response can also be measured by measuring the level of decreased cell death following one or more administrations to a cell population; e.g., cell death is 10%, 25%, 50%, 75%, 85%, 90%, 95%, or over 95% less than the cell death frequency observed with a reference compound. Moreover, cell death may affect fewer than 50%, 40%, 30%, 20%, 10%, 5%, 1%, 0.1%, 0.01% or fewer than 0.01% of cells contacted with the polynucleotide, primary construct or mmRNA.

In another embodiment, the polynucleotide, primary construct or mmRNA of the present invention is significantly less immunogenic than an unmodified in vitro-synthesized RNA molecule polynucleotide, or primary construct with the same sequence or a reference compound. As used herein, "significantly less immunogenic" refers to a detectable decrease in immunogenicity. In another embodiment, the term refers to a fold decrease in immunogenicity. In another embodiment, the term refers to a decrease such that an effective amount of the polynucleotide, primary construct or mmRNA can be administered without triggering a detectable immune response. In another embodiment, the term refers to a decrease such that the polynucleotide, primary construct or mmRNA can be repeatedly administered without eliciting an immune response sufficient to detectably reduce expression of the recombinant protein. In another embodiment, the decrease is such that the polynucleotide, primary construct or mmRNA can be repeatedly administered without eliciting an immune response sufficient to eliminate detectable expression of the recombinant protein.

In another embodiment, the polynucleotide, primary construct or mmRNA is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL-12, IFNalpha, TNF-alpha, RANTES, MIP-1alpha or beta, IL-6, IFN-beta, or IL-8), measuring expression of DC activation markers (e.g. CD83, HLA-DR, CD80 and CD86), or measuring ability to act as an adjuvant for an adaptive immune response.

The polynucleotide, primary construct or mmRNA of the invention, including the combination of modifications taught herein may have superior properties making them more suitable as therapeutic modalities.

It has been determined that the "all or none" model in the art is sorely insufficient to describe the biological phenomena associated with the therapeutic utility of modified mRNA. The present inventors have determined that to improve protein production, one may consider the nature of the modification, or combination of modifications, the percent modification and survey more than one cytokine or metric to determine the efficacy and risk profile of a particular modified mRNA.

In one aspect of the invention, methods of determining the effectiveness of a modified mRNA as compared to unmodified involves the measure and analysis of one or more cytokines whose expression is triggered by the administration of the exogenous nucleic acid of the invention. These values are compared to administration of an unmodified nucleic acid or to a standard metric such as cytokine response, PolyIC, R-848 or other standard known in the art.

One example of a standard metric developed herein is the measure of the ratio of the level or amount of encoded polypeptide (protein) produced in the cell, tissue or organism to the level or amount of one or more (or a panel) of cytokines whose expression is triggered in the cell, tissue or organism as a result of administration or contact with the modified nucleic acid. Such ratios are referred to herein as the Protein:Cytokine Ratio or "PC" Ratio. The higher the PC ratio, the more efficacioius the modified nucleic acid (polynucleotide encoding the protein measured). Preferred PC Ratios, by cytokine, of the present invention may be greater than 1, greater than 10, greater than 100, greater than 1000, greater than 10,000 or more. Modified nucleic acids having higher PC Ratios than a modified nucleic acid of a different or unmodified construct are preferred.

The PC ratio may be further qualified by the percent modification present in the polynucleotide. For example, normalized to a 100% modified nucleic acid, the protein production as a function of cytokine (or risk) or cytokine profile can be determined.

In one embodiment, the present invention provides a method for determining, across chemistries, cytokines or percent modification, the relative efficacy of any particular modified the polynucleotide, primary construct or mmRNA by comparing the PC Ratio of the modified nucleic acid (polynucleotide, primary construct or mmRNA).

mmRNA containing varying levels of nucleobase substitutions could be produced that maintain increased protein production and decreased immunostimulatory potential. The relative percentage of any modified nucleotide to its naturally occurring nucleotide counterpart can be varied during the IVT reaction (for instance, 100, 50, 25, 10, 5, 2.5, 1, 0.1, 0.01% 5 methyl cytidine usage versus cytidine; 100, 50, 25, 10, 5, 2.5, 1, 0.1, 0.01% pseudouridine or N1-methyl-pseudouridine usage versus uridine). mmRNA can also be made that utilize different ratios using 2 or more different nucleotides to the same base (for instance, different ratios of pseudouridine and N1-methyl-pseudouridine). mmRNA can also be made with mixed ratios at more than 1 "base" position, such as ratios of 5 methyl cytidine/cytidine and pseudouridine/N1-methyl-pseudouridine/uridine at the same time. Use of modified mRNA with altered ratios of modified nucleotides can be beneficial in reducing potential exposure to chemically modified nucleotides. Lastly, positional introduction of modified nucleotides into the mmRNA which modulate either protein production or immunostimulatory potential or both is also possible. The ability of such mmRNA to demonstrate these improved properties can be assessed in vitro (using assays such as the PBMC assay described herein), and can also be assessed in vivo through measurement of both mmRNA-encoded protein production and mediators of innate immune recognition such as cytokines.

In another embodiment, the relative immunogenicity of the polynucleotide, primary construct or mmRNA and its unmodified counterpart are determined by determining the quantity of the polynucleotide, primary construct or mmRNA required to elicit one of the above responses to the same degree as a given quantity of the unmodified nucleotide or reference compound. For example, if twice as much polynucleotide, primary construct or mmRNA is required to elicit the same response, than the polynucleotide, primary construct or mmRNA is two-fold less immunogenic than the unmodified nucleotide or the reference compound.

In another embodiment, the relative immunogenicity of the polynucleotide, primary construct or mmRNA and its unmodified counterpart are determined by determining the quantity of cytokine (e.g. IL-12, IFNalpha, TNF-alpha, RANTES, MIP-1alpha or beta, IL-6, IFN-beta, or IL-8) secreted in response to administration of the polynucleotide, primary construct or mmRNA, relative to the same quantity of the unmodified nucleotide or reference compound. For example, if one-half as much cytokine is secreted, than the polynucleotide, primary construct or mmRNA is two-fold less immunogenic than the unmodified nucleotide. In another embodiment, background levels of stimulation are subtracted before calculating the immunogenicity in the above methods.

Provided herein are also methods for performing the titration, reduction or elimination of the immune response in a cell or a population of cells. In some embodiments, the cell is contacted with varied doses of the same polynucleotides, primary constructs or mmRNA and dose response is evaluated. In some embodiments, a cell is contacted with a number of different polynucleotides, primary constructs or mmRNA at the same or different doses to determine the optimal composition for producing the desired effect. Regarding the immune response, the desired effect may be to avoid, evade or reduce the immune response of the cell. The desired effect may also be to alter the efficiency of protein production.

The polynucleotides, primary constructs and/or mmRNA of the present invention may be used to reduce the immune response using the method described in International Publication No. WO2013003475, herein incorporated by reference in its entirety.

Activation of the Immune Response: Vaccines

Additionally, certain modified nucleosides, or combinations thereof, when introduced into the oncology-related polynucleotides, primary constructs or mmRNA of the invention will activate the innate immune response. Such activating molecules are useful as adjuvants when combined with polypeptides and/or other vaccines. In certain embodiments, the activating molecules contain a translatable region which encodes for a polypeptide sequence useful as a vaccine, thus providing the ability to be a self-adjuvant.

In one embodiment, the oncology-related polynucleotides, primary constructs and/or mmRNA of the invention may encode an immunogen. The delivery of the oncology-related polynucleotides, primary constructs and/or mmRNA encoding an immunogen may activate the immune response. As a non-limiting example, the oncology-related polynucleotides, primary constructs and/or mmRNA encoding an immunogen may be delivered to cells to trigger multiple innate response pathways (see International Pub. No. WO2012006377; herein incorporated by reference in its entirety). As another non-limiting example, the oncology-related polynucleotides, primary constructs and mmRNA of the present invention encoding an immunogen may be delivered to a vertebrate in a dose amount large enough to be immunogenic to the vertebrate (see International Pub. Nos. WO2012006372 and WO2012006369; each of which is herein incorporated by reference in their entirety).

The oncology-related polynucleotides, primary constructs or mmRNA of invention may encode a polypeptide sequence for a vaccine and may further comprise an inhibitor. The inhibitor may impair antigen presentation and/or inhibit various pathways known in the art. As a non-limiting example, the oncology-related polynucleotides, primary constructs or mmRNA of the invention may be used for a vaccine in combination with an inhibitor which can impair antigen presentation (see International Pub. No. WO2012089225 and WO2012089338; each of which is herein incorporated by reference in their entirety).

In one embodiment, the oncology-related polynucleotides, primary constructs or mmRNA of the invention may be self-replicating RNA. Self-replicating RNA molecules can enhance efficiency of RNA delivery and expression of the enclosed gene product. In one embodiment, the oncology-related polynucleotides, primary constructs or mmRNA may comprise at least one modification described herein and/or known in the art. In one embodiment, the self-replicating RNA can be designed so that the self-replicating RNA does not induce production of infectious viral particles. As a non-limiting example the self-replicating RNA may be designed by the methods described in US Pub. No. US20110300205 and International Pub. No. WO2011005799, each of which is herein incorporated by reference in their entirety.

In one embodiment, the self-replicating polynucleotides, primary constructs or mmRNA of the invention may encode a protein which may raise the immune response. As a non-limiting example, the oncology-related polynucleotides, primary constructs or mmRNA may be self-replicating mRNA may encode at least one antigen (see US Pub. No. US20110300205 and International Pub. Nos. WO2011005799, WO2013006838 and WO2013006842; each of which is herein incorporated by reference in their entirety).

In one embodiment, the self-replicating polynucleotides, primary constructs or mmRNA of the invention may be formulated using methods described herein or known in the art. As a non-limiting example, the self-replicating RNA may be formulated for delivery by the methods described in Geall et al (Nonviral delivery of self-amplifying RNA vaccines, PNAS 2012; PMID: 22908294).

In one embodiment, the oncology-related polynucleotides, primary constructs or mmRNA of the present invention may encode amphipathic and/or immunogenic amphipathic peptides.

In on embodiment, a formulation of the oncology-related polynucleotides, primary constructs or mmRNA of the present invention may further comprise an amphipathic and/or immunogenic amphipathic peptide. As a non-limiting example, the oncology-related polynucleotides, primary constructs or mmRNA comprising an amphipathic and/or immunogenic amphipathic peptide may be formulated as described in US. Pub. No. US20110250237 and International Pub. Nos. WO2010009277 and WO2010009065; each of which is herein incorporated by reference in their entirety.

In one embodiment, the oncology-related polynucleotides, primary constructs or mmRNA of the present invention may be immunostimultory. As a non-limiting example, the oncology-related polynucleotides, primary constructs or mmRNA may encode all or a part of a positive-sense or a negative-sense stranded RNA virus genome (see International Pub No. WO2012092569 and US Pub No. US20120177701, each of which is herein incorporated by reference in their entirety). In another non-limiting example, the immunostimulatory polynucleotides, primary constructs or mmRNA of the present invention may be formulated with an excipient for administration as described herein and/or known in the art (see International Pub No. WO2012068295 and US Pub No. US20120213812, each of which is herein incorporated by reference in their entirety).

In one embodiment, the response of the vaccine formulated by the methods described herein may be enhanced by the addition of various compounds to induce the therapeutic effect. As a non-limiting example, the vaccine formulation may include a MHC II binding peptide or a peptide having a similar sequence to a MHC II binding peptide (see International Pub Nos. WO2012027365, WO2011031298 and US Pub No. US20120070493, US20110110965, each of which is herein incorporated by reference in their entirety). As another example, the vaccine formulations may comprise modified nicotinic compounds which may generate an antibody response to nicotine residue in a subject (see International Pub No. WO2012061717 and US Pub No. US20120114677, each of which is herein incorporated by reference in their entirety).

Naturally Occurring Mutants

In another embodiment, the polynucleotides, primary construct and/or mmRNA can be utilized to express variants of naturally occurring proteins that have an improved disease modifying activity, including increased biological activity, improved patient outcomes, or a protective function, etc. Many such modifier genes have been described in mammals (Nadeau, Current Opinion in Genetics & Development 2003 13:290-295; Hamilton and Yu, PLoS Genet. 2012; 8:e1002644; Corder et al., Nature Genetics 1994 7:180-184; all herein incorporated by reference in their entireties). Examples in humans include Apo E2 protein, Apo A-I variant proteins (Apo A-I Milano, Apo A-I Paris), hyperactive Factor IX protein (Factor IX Padua Arg338Lys), transthyretin mutants (TTR Thr119Met). Expression of ApoE2 (cys112, cys158) has been shown to confer protection relative to other ApoE isoforms (ApoE3 (cys112, arg158), and ApoE4 (arg112, arg158)) by reducing susceptibility to Alzheimer's disease and possibly other conditions such as cardiovascular disease (Corder et al., Nature Genetics 1994 7:180-184; Seripa et al., Rejuvenation Res. 2011 14:491-500; Liu et al. Nat Rev Neurol. 2013 9:106-118; all herein incorporated by reference in their entireties). Expression of Apo A-I variants has been associated with reduced cholesterol (deGoma and Rader, 2011 Nature Rev Cardiol 8:266-271; Nissen et al., 2003 JAMA 290:2292-2300; all herein incorporated by reference in its entirety). The amino acid sequence of ApoA-I in certain populations has been changed to cysteine in Apo A-I Milano (Arg 173 changed to Cys) and in Apo A-I Paris (Arg 151 changed to Cys). Factor IX mutation at position R338L (FIX Padua) results in a Factor IX protein that has ~10-fold increased activity (Simioni et al., N Engl J Med. 2009 361: 1671-1675; Finn et al., Blood. 2012 120:4521-4523; Cantore et al., Blood. 2012 120:4517-20; all herein incorporated by reference in their entireties). Mutation of transthyretin at positions 104 or 119 (Arg104 His, Thr119Met) has been shown to provide protection to patients also harboring the disease causing Va130Met mutations (Saraiva, Hum Mutat. 2001 17:493-503; DATA BASE ON TRANSTHYRETIN MUTATIONS www.ibmc.up.pt/mjsaraiva/ttrmut.html; all herein incorporated by reference in its entirety). Differences in clinical presentation and severity of symptoms among Portuguese and Japanese Met 30 patients carrying respectively the Met 119 and the His104 mutations are observed with a clear protective effect exerted by the non pathogenic mutant (Coelho et al. 1996 Neuromuscular Disorders (Suppl) 6: S20; Terazaki et al. 1999. Biochem Biophys Res Commun 264: 365-370; all herein incorporated by reference in its entirety), which confer more stability to the molecule. A modified mRNA encoding these protective TTR alleles can be expressed in TTR amyloidosis patients, thereby reducing the effect of the pathogenic mutant TTR protein.

Major Groove Interacting Partners

As described herein, the phrase "major groove interacting partner" refers to RNA recognition receptors that detect and respond to RNA ligands through interactions, e.g. binding, with the major groove face of a nucleotide or nucleic acid. As such, RNA ligands comprising modified nucleotides or nucleic acids such as the polynucleotide, primary construct or mmRNA as described herein decrease interactions with major groove binding partners, and therefore decrease an innate immune response.

Example major groove interacting, e.g. binding, partners include, but are not limited to the following nucleases and helicases. Within membranes, TLRs (Toll-like Receptors) 3, 7, and 8 can respond to single- and double-stranded RNAs. Within the cytoplasm, members of the superfamily 2 class of DEX(D/H) helicases and ATPases can sense RNAs to initiate antiviral responses. These helicases include the RIG-I (retinoic acid-inducible gene I) and MDA5 (melanoma differentiation-associated gene 5). Other examples include laboratory of genetics and physiology 2 (LGP2), HIN200 domain containing proteins, or Helicase-domain containing proteins.

Targeting of Pathogenic Organisms or Diseased Cells

Provided herein are methods for targeting pathogenic microorganisms, such as bacteria, yeast, protozoa, helminthes and the like, or diseased cells such as cancer cells using polynucleotides, primary constructs or mmRNA that encode cytostatic or cytotoxic polypeptides. Preferably the mRNA introduced contains modified nucleosides or other nucleic acid sequence modifications that are translated exclusively, or preferentially, in the target pathogenic organism, to reduce possible off-target effects of the therapeutic. Such methods are useful for removing pathogenic organisms or killing diseased cells found in any biological material, including blood, semen, eggs, and transplant materials including embryos, tissues, and organs.

Bioprocessing

The methods provided herein may be useful for enhancing protein product yield in a cell culture process. In a cell culture containing a plurality of host cells, introduction of a polynucleotide, primary construct or mmRNA described herein results in increased protein production efficiency relative to a corresponding unmodified nucleic acid. Such increased protein production efficiency can be demonstrated, e.g., by showing increased cell transfection, increased protein translation from the polynucleotide, primary construct or mmRNA, decreased nucleic acid degradation, and/or reduced innate immune response of the host cell. Protein production can be measured by enzyme-linked immunosorbent assay (ELISA), and protein activity can be measured by various functional assays known in the art. The protein production may be generated in a continuous or a batch-fed mammalian process.

Additionally, it is useful to optimize the expression of a specific polypeptide in a cell line or collection of cell lines of potential interest, particularly a polypeptide of interest such as a protein variant of a reference protein having a known activity. In one embodiment, provided is a method of optimizing expression of a polypeptide of interest in a target cell, by providing a plurality of target cell types, and independently contacting with each of the plurality of target cell types a polynucleotide, primary construct or mmRNA encoding a polypeptide of interest. The cells may be transfected with two or more polynucleotide, primary construct or mmRNA simultaneously or sequentially.

In certain embodiments, multiple rounds of the methods described herein may be used to obtain cells with increased expression of one or more nucleic acids or proteins of interest. For example, cells may be transfected with one or more polynucleotide, primary construct or mmRNA that encode a nucleic acid or protein of interest. The cells may be isolated according to methods described herein before being subjected to further rounds of transfections with one or more other nucleic acids which encode a nucleic acid or protein of interest before being isolated again. This method may be useful for generating cells with increased expression of a complex of proteins, nucleic acids or proteins in the same or related biological pathway, nucleic acids or proteins that act upstream or downstream of each other, nucleic acids or proteins that have a modulating, activating or repressing function to each other, nucleic acids or proteins that are dependent on each other for function or activity, or nucleic acids or proteins that share homology.

Additionally, culture conditions may be altered to increase protein production efficiency. Subsequently, the presence and/or level of the polypeptide of interest in the plurality of target cell types is detected and/or quantitated, allowing for the optimization of a polypeptide's expression by selection of an efficient target cell and cell culture conditions relating thereto. Such methods are particularly useful when the polypeptide contains one or more post-translational modifications or has substantial tertiary structure, situations which often complicate efficient protein production.

In one embodiment, the cells used in the methods of the present invention may be cultured. The cells may be cultured in suspension or as adherent cultures. The cells may be cultured in a varied of vessels including, but not limited to, bioreactors, cell bags, wave bags, culture plates, flasks and other vessels well known to those of ordinary skill in the art. Cells may be cultured in IMDM (Invitrogen, Catalog number 12440-53) or any other suitable media including, but not limited to, chemically defined media formulations. The ambient conditions which may be suitable for cell culture, such as temperature and atmospheric composition, are well known to those skilled in the art. The methods of the invention may be used with any cell that is suitable for use in protein production.

The invention provides for the repeated introduction (e.g., transfection) of modified nucleic acids into a target cell population, e.g., in vitro, ex vivo, in situ, or in vivo. For example, contacting the same cell population may be repeated one or more times (such as two, three, four, five or more than five times). In some embodiments, the step of contacting the cell population with the oncology-related polynucleotides, primary constructs or mmRNA is repeated a number of times sufficient such that a predetermined efficiency of protein translation in the cell population is achieved. Given the often reduced cytotoxicity of the target cell population provided by the nucleic acid modifications, repeated transfections are achievable in a diverse array of cell types and within a variety of tissues, as provided herein.

In one embodiment, the bioprocessing methods of the present invention may be used to produce antibodies or functional fragments thereof. The functional fragments may comprise a Fab, Fab', F(ab')$_2$, an Fv domain, an scFv, or a diabody. They may be variable in any region including the complement determining region (CDR). In one embodiment, there is complete diversity in the CDR3 region. In another embodiment, the antibody is substantially conserved except in the CDR3 region.

Antibodies may be made which bind or associate with any biomolecule, whether human, pathogenic or non-human in origin. The pathogen may be present in a non-human mammal, a clinical specimen or from a commercial product such as a oncology-related or pharmaceutical material. They may also bind to any specimen or sample including clinical specimens or tissue samples from any organism.

In some embodiments, the contacting step is repeated multiple times at a frequency selected from the group consisting of: 6 hour, 12 hour, 24 hour, 36 hour, 48 hour, 72 hour, 84 hour, 96 hour, and 108 hour and at concentrations of less than 20 nM, less than 50 nM, less than 80 nM or less than 100 nM. Compositions may also be administered at less than 1 mM, less than 5 mM, less than 10 mM, less than 100 mM or less than 500 mM.

In some embodiments, the oncology-related polynucleotides, primary constructs or mmRNA are added at an amount of 50 molecules per cell, 100 molecules/cell, 200 molecules/cell, 300 molecules/cell, 400 molecules/cell, 500 molecules/cell, 600 molecules/cell, 700 molecules/cell, 800 molecules/cell, 900 molecules/cell, 1000 molecules/cell, 2000 molecules/cell, or 5000 molecules/cell.

In other embodiments, the oncology-related polynucleotides, primary constructs or mmRNA are added at a concentration selected from the group consisting of: 0.01 fmol/106 cells, 0.1 fmol/106 cells, 0.5 fmol/106 cells, 0.75 fmol/106 cells, 1 fmol/106 cells, 2 fmol/106 cells, 5 fmol/106 cells, 10 fmol/106 cells, 20 fmol/106 cells, 30 fmol/106 cells, 40 fmol/106 cells, 50 fmol/106 cells, 60 fmol/106 cells, 100 fmol/106 cells, 200 fmol/106 cells, 300 fmol/106 cells, 400 fmol/106 cells, 500 fmol/106 cells, 700 fmol/106 cells, 800 fmol/106 cells, 900 fmol/106 cells, and 1 pmol/106 cells.

In some embodiments, the production of a biological product upon is detected by monitoring one or more measurable bioprocess parameters, such as a parameter selected from the group consisting of: cell density, pH, oxygen levels, glucose levels, lactic acid levels, temperature, and protein production. Protein production can be measured as specific productivity (SP) (the concentration of a product, such as a heterologously expressed polypeptide, in solution) and can be expressed as mg/L or g/L; in the alternative, specific productivity can be expressed as pg/cell/day. An increase in SP can refer to an absolute or relative increase in the concentration of a product produced under two defined set of conditions (e.g., when compared with controls not treated with modified mRNA(s)).

Cells

In one embodiment, the cells are selected from the group consisting of mammalian cells, bacterial cells, plant, microbial, algal and fungal cells. In some embodiments, the cells are mammalian cells, such as, but not limited to, human, mouse, rat, goat, horse, rabbit, hamster or cow cells. In a further embodiment, the cells may be from an established cell line, including, but not limited to, HeLa, NS0, SP2/0, KEK 293T, Vero, Caco, Caco-2, MDCK, COS-1, COS-7, K562, Jurkat, CHO-K1, DG44, CHOK1SV, CHO-S, Huvec, CV-1, Huh-7, NIH3T3, HEK293, 293, A549, HepG2, IMR-90, MCF-7, U-20S, Per.C6, SF9, SF21 or Chinese Hamster Ovary (CHO) cells.

In certain embodiments, the cells are fungal cells, such as, but not limited to, *Chrysosporium* cells, *Aspergillus* cells, *Trichoderma* cells, *Dictyostelium* cells, *Candida* cells, *Saccharomyces* cells, *Schizosaccharomyces* cells, and *Penicillium* cells.

In certain embodiments, the cells are bacterial cells such as, but not limited to, E. coli, B. subtilis, or BL21 cells. Primary and secondary cells to be transfected by the methods of the invention can be obtained from a variety of tissues and include, but are not limited to, all cell types which can be maintained in culture. For examples, primary and secondary cells which can be transfected by the methods of the invention include, but are not limited to, fibroblasts, keratinocytes, epithelial cells (e.g., mammary epithelial cells, intestinal epithelial cells), endothelial cells, glial cells, neural cells, formed elements of the blood (e.g., lymphocytes, bone marrow cells), muscle cells and precursors of these somatic cell types. Primary cells may also be obtained from a donor of the same species or from another species (e.g., mouse, rat, rabbit, cat, dog, pig, cow, bird, sheep, goat, horse).

Purification and Isolation

Those of ordinary skill in the art should be able to make a determination of the methods to use to purify or isolate of a protein of interest from cultured cells. Generally, this is done through a capture method using affinity binding or non-affinity purification. If the protein of interest is not secreted by the cultured cells, then a lysis of the cultured cells should be performed prior to purification or isolation. One may use unclarified cell culture fluid containing the protein of interest along with cell culture media components as well as cell culture additives, such as anti-foam compounds and other nutrients and supplements, cells, cellular debris, host cell proteins, DNA, viruses and the like in the present invention. The process may be conducted in the bioreactor itself. The fluid may either be preconditioned to a desired stimulus such as pH, temperature or other stimulus characteristic or the fluid can be conditioned upon the addition of polymer(s) or the polymer(s) can be added to a carrier liquid that is properly conditioned to the required parameter for the stimulus condition required for that polymer to be solubilized in the fluid. The polymer may be allowed to circulate thoroughly with the fluid and then the stimulus may be applied (change in pH, temperature, salt concentration, etc) and the desired protein and polymer(s) precipitate can out of the solution. The polymer and the desired protein(s) can be separated from the rest of the fluid and optionally washed one or more times to remove any trapped or loosely bound contaminants. The desired protein may then be recovered from the polymer(s) by, for example, elution and the like. Preferably, the elution may be done under a set of conditions such that the polymer remains in its precipitated form and retains any impurities to it during the selected elution of the desired protein. The polymer and protein as well as any impurities may be solubilized in a new fluid such as water or a buffered solution and the protein may be recovered by a means such as affinity, ion exchanged, hydrophobic, or some other type of chromatography that has a preference and selectivity for the protein over that of the polymer or impurities. The eluted protein may then be recovered and may be subjected to additional processing steps, either batch like steps or continuous flow through steps if appropriate.

In another embodiment, it may be useful to optimize the expression of a specific polypeptide in a cell line or collection of cell lines of potential interest, particularly a polypeptide of interest such as a protein variant of a reference protein having a known activity. In one embodiment, provided is a method of optimizing expression of a polypeptide of interest in a target cell, by providing a plurality of target cell types, and independently contacting with each of the plurality of target cell types a modified mRNA encoding a polypeptide. Additionally, culture conditions may be altered to increase protein production efficiency. Subsequently, the presence and/or level of the polypeptide of interest in the plurality of target cell types is detected and/or quantitated, allowing for the optimization of a polypeptide of interest's expression by selection of an efficient target cell and cell culture conditions relating thereto. Such methods may be useful when the polypeptide of interest contains one or more post-translational modifications or has substantial tertiary structure, which often complicate efficient protein production.

Protein Recovery

The protein of interest may be preferably recovered from the culture medium as a secreted polypeptide, or it can be recovered from host cell lysates if expressed without a secretory signal. It may be necessary to purify the protein of interest from other recombinant proteins and host cell proteins in a way that substantially homogenous preparations of the protein of interest are obtained. The cells and/or particulate cell debris may be removed from the culture medium or lysate. The product of interest may then be purified from contaminant soluble proteins, polypeptides and nucleic acids by, for example, fractionation on immunoaffinity or ion-exchange columns, ethanol precipitation, reverse phase HPLC (RP-HPLC), SEPHADEX® chromatography, chromatography on silica or on a cation exchange resin such as DEAE. Methods of purifying a protein heterologous expressed by a host cell are well known in the art.

Methods and compositions described herein may be used to produce proteins which are capable of attenuating or blocking the endogenous agonist biological response and/or antagonizing a receptor or signaling molecule in a mammalian subject. For example, IL-12 and IL-23 receptor signaling may be enhanced in chronic autoimmune disorders such as multiple sclerosis and inflammatory diseases such as rheumatoid arthritis, psoriasis, lupus erythematosus, ankylosing spondylitis and Chron's disease (Kikly K, Liu L, Na S, Sedgwich J D (2006) Cur. Opin. Immunol. 18(6): 670-5). In another embodiment, a nucleic acid encodes an antagonist for chemokine receptors. Chemokine receptors CXCR-4 and CCR-5 are required for HIV enry into host cells (Arenzana-Seisdedos F et al, (1996) Nature. October 3; 383 (6599):400).

Gene Silencing

The oncology-related polynucleotides, primary constructs and mmRNA described herein are useful to silence (i.e., prevent or substantially reduce) expression of one or more target genes in a cell population. A polynucleotide, primary construct or mmRNA encoding a polypeptide of interest capable of directing sequence-specific histone H3 methylation is introduced into the cells in the population under conditions such that the polypeptide is translated and reduces gene transcription of a target gene via histone H3 methylation and subsequent heterochromatin formation. In some embodiments, the silencing mechanism is performed on a cell population present in a mammalian subject. By way of non-limiting example, a useful target gene is a mutated Janus Kinase-2 family member, wherein the mammalian subject expresses the mutant target gene suffers from a myeloproliferative disease resulting from aberrant kinase activity.

Co-administration of oncology-related polynucleotides, primary constructs and mmRNA and RNAi agents are also provided herein.

Modulation of Biological Pathways

The rapid translation polynucleotides, primary constructs and mmRNA introduced into cells provides a desirable mechanism of modulating target biological pathways. Such modulation includes antagonism or agonism of a given pathway. In one embodiment, a method is provided for antagonizing a biological pathway in a cell by contacting the cell with an effective amount of a composition comprising a polynucleotide, primary construct or mmRNA encoding a polypeptide of interest, under conditions such that the oncology-related polynucleotides, primary constructs and mmRNA is localized into the cell and the polypeptide is capable of being translated in the cell from the oncology-related polynucleotides, primary constructs and mmRNA, wherein the polypeptide inhibits the activity of a polypeptide functional in the biological pathway. Exemplary biological pathways are those defective in an autoimmune or inflammatory disorder such as multiple sclerosis, rheumatoid arthritis, psoriasis, lupus erythematosus, ankylosing spondylitis colitis, or Crohn's disease; in particular, antagonism of the IL-12 and IL-23 signaling pathways are of particular utility. (See Kikly K, Liu L, Na S, Sedgwick J D (2006) Curr. Opin. Immunol. 18 (6): 670-5; herein incorporated by reference in its entirety).

Further, provided are oncology-related polynucleotide, primary construct or mmRNA encoding an antagonist for chemokine receptors; chemokine receptors CXCR-4 and CCR-5 are required for, e.g., HIV entry into host cells (Arenzana-Seisdedos F et al, (1996) Nature. October 3; 383(6599): 400; herein incorporated by reference in its entirety).

Alternatively, provided are methods of agonizing a biological pathway in a cell by contacting the cell with an effective amount of an oncology-related polynucleotide, primary construct or mmRNA encoding a recombinant polypeptide under conditions such that the nucleic acid is localized into the cell and the recombinant polypeptide is capable of being translated in the cell from the nucleic acid, and the recombinant polypeptide induces the activity of a polypeptide functional in the biological pathway. Exemplary agonized biological pathways include pathways that modulate cell fate determination. Such agonization is reversible or, alternatively, irreversible.

Expression of Ligand or Receptor on Cell Surface

In some aspects and embodiments of the aspects described herein, the oncology-related polynucleotides, primary constructs or mmRNA described herein can be used to express a ligand or ligand receptor on the surface of a cell (e.g., a homing moiety). A ligand or ligand receptor moiety attached to a cell surface can permit the cell to have a desired biological interaction with a tissue or an agent in vivo. A ligand can be an antibody, an antibody fragment, an aptamer, a peptide, a vitamin, a carbohydrate, a protein or polypeptide, a receptor, e.g., cell-surface receptor, an adhesion molecule, a glycoprotein, a sugar residue, a therapeutic agent, a drug, a glycosaminoglycan, or any combination thereof. For example, a ligand can be an antibody that recognizes a cancer-cell specific antigen, rendering the cell capable of preferentially interacting with tumor cells to permit tumor-specific localization of a modified cell. A ligand can confer the ability of a cell composition to accumulate in a tissue to be treated, since a preferred ligand may be capable of interacting with a target molecule on the external face of a tissue to be treated. Ligands having limited cross-reactivity to other tissues are generally preferred.

In some cases, a ligand can act as a homing moiety which permits the cell to target to a specific tissue or interact with a specific ligand. Such homing moieties can include, but are not limited to, any member of a specific binding pair, antibodies, monoclonal antibodies, or derivatives or analogs thereof, including without limitation: Fv fragments, single chain Fv (scFv) fragments, Fab' fragments, F(ab')2 fragments, single domain antibodies, camelized antibodies and antibody fragments, humanized antibodies and antibody fragments, and multivalent versions of the foregoing; multivalent binding reagents including without limitation: monospecific or bispecific antibodies, such as disulfide stabilized Fv fragments, scFv tandems ((SCFV)2 fragments), diabodies, tribodies or tetrabodies, which typically are covalently linked or otherwise stabilized (i.e., leucine zipper or helix stabilized) scFv fragments; and other homing moieties include for example, aptamers, receptors, and fusion proteins.

In some embodiments, the homing moiety may be a surface-bound antibody, which can permit tuning of cell targeting specificity. This is especially useful since highly specific antibodies can be raised against an epitope of interest for the desired targeting site. In one embodiment, multiple antibodies are expressed on the surface of a cell, and each antibody can have a different specificity for a desired target. Such approaches can increase the avidity and specificity of homing interactions.

A skilled artisan can select any homing moiety based on the desired localization or function of the cell, for example an estrogen receptor ligand, such as tamoxifen, can target cells to estrogen-dependent breast cancer cells that have an increased number of estrogen receptors on the cell surface. Other non-limiting examples of ligand/receptor interactions include CCRI (e.g., for treatment of inflamed joint tissues or brain in rheumatoid arthritis, and/or multiple sclerosis), CCR7, CCR8 (e.g., targeting to lymph node tissue), CCR6, CCR9, CCR10 (e.g., to target to intestinal tissue), CCR4, CCR10 (e.g., for targeting to skin), CXCR4 (e.g., for general enhanced transmigration), HCELL (e.g., for treatment of inflammation and inflammatory disorders, bone marrow), Alpha4beta7 (e.g., for intestinal mucosa targeting), VLA-4/VCAM-1 (e.g., targeting to endothelium). In general, any receptor involved in targeting (e.g., cancer metastasis) can be harnessed for use in the methods and compositions described herein.

Modulation of Cell Lineage

Provided are methods of inducing an alteration in cell fate in a target mammalian cell. The target mammalian cell may be a precursor cell and the alteration may involve driving differentiation into a lineage, or blocking such differentiation. Alternatively, the target mammalian cell may be a differentiated cell, and the cell fate alteration includes driving de-differentiation into a pluripotent precursor cell, or blocking such de-differentiation, such as the dedifferentiation of cancer cells into cancer stem cells. In situations where a change in cell fate is desired, effective amounts of mRNAs encoding a cell fate inductive polypeptide is introduced into a target cell under conditions such that an alteration in cell fate is induced. In some embodiments, the modified mRNAs are useful to reprogram a subpopulation of cells from a first phenotype to a second phenotype. Such a reprogramming may be temporary or permanent.

Optionally, the reprogramming induces a target cell to adopt an intermediate phenotype.

Additionally, the methods of the present invention are particularly useful to generate induced pluripotent stem cells (iPS cells) because of the high efficiency of transfection, the ability to re-transfect cells, and the tenability of the amount of recombinant polypeptides produced in the target cells. Further, the use of iPS cells generated using the methods described herein is expected to have a reduced incidence of teratoma formation.

Also provided are methods of reducing cellular differentiation in a target cell population. For example, a target cell population containing one or more precursor cell types is contacted with a composition having an effective amount of a polynucleotides, primary constructs and mmRNA encoding a polypeptide, under conditions such that the polypeptide is translated and reduces the differentiation of the precursor cell. In non-limiting embodiments, the target cell population contains injured tissue in a mammalian subject or tissue affected by a surgical procedure. The precursor cell is, e.g., a stromal precursor cell, a neural precursor cell, or a mesenchymal precursor cell.

In a specific embodiment, provided are polynucleotide, primary construct or mmRNA that encode one or more differentiation factors Gata4, Mef2c and Tbx4. These mRNA-generated factors are introduced into fibroblasts and drive the reprogramming into cardiomyocytes. Such a reprogramming can be performed in vivo, by contacting an mRNA-containing patch or other material to damaged cardiac tissue to facilitate cardiac regeneration. Such a process promotes cardiomyocyte genesis as opposed to fibrosis.

Mediation of Cell Death

In one embodiment, polynucleotides, primary constructs or mmRNA compositions can be used to induce apoptosis in a cell (e.g., a cancer cell) by increasing the expression of a death receptor, a death receptor ligand or a combination thereof. This method can be used to induce cell death in any desired cell and has particular usefulness in the treatment of cancer where cells escape natural apoptotic signals.

Apoptosis can be induced by multiple independent signaling pathways that converge upon a final effector mechanism consisting of multiple interactions between several "death receptors" and their ligands, which belong to the tumor necrosis factor (TNF) receptor/ligand superfamily. The best-characterized death receptors are CD95 ("Fas"), TNFRI (p55), death receptor 3 (DR3 or Apo3/TRAMO), DR4 and DR5 (apo2-TRAIL-R2). The final effector mechanism of apoptosis may be the activation of a series of proteinases designated as caspases. The activation of these caspases results in the cleavage of a series of vital cellular proteins and cell death. The molecular mechanism of death receptors/ligands-induced apoptosis is well known in the art. For example, Fas/FasL-mediated apoptosis is induced by binding of three FasL molecules which induces trimerization of Fas receptor via C-terminus death domains (DDs), which in turn recruits an adapter protein FADD (Fas-associated protein with death domain) and Caspase-8. The oligomerization of this trimolecular complex, Fas/FAIDD/caspase-8, results in proteolytic cleavage of proenzyme caspase-8 into active caspase-8 that, in turn, initiates the apoptosis process by activating other downstream caspases through proteolysis, including caspase-3. Death ligands in general are apoptotic when formed into trimers or higher order of structures. As monomers, they may serve as antiapoptotic agents by competing with the trimers for binding to the death receptors.

In one embodiment, the oncology-related polynucleotides, primary constructs or mmRNA composition encodes for a death receptor (e.g., Fas, TRAIL, TRAMO, TNFR, TLR etc). Cells made to express a death receptor by transfection of oncology-related polynucleotides, primary constructs and mmRNA become susceptible to death induced by the ligand that activates that receptor. Similarly, cells made to express a death ligand, e.g., on their surface, will induce death of cells with the receptor when the transfected cell contacts the target cell. In another embodiment, the oncology-related polynucleotides, primary constructs and mmRNA composition encodes for a death receptor ligand (e.g., FasL, TNF, etc). In another embodiment, the oncology-related polynucleotides, primary constructs and mmRNA composition encodes a caspase (e.g., caspase 3, caspase 8, caspase 9 etc). Where cancer cells often exhibit a failure to properly differentiate to a non-proliferative or controlled proliferative form, in another embodiment, the synthetic, polynucleotides, primary constructs and mmRNA composition encodes for both a death receptor and its appropriate activating ligand. In another embodiment, the synthetic, polynucleotides, primary constructs and mmRNA composition encodes for a differentiation factor that when expressed in the cancer cell, such as a cancer stem cell, will induce the cell to differentiate to a non-pathogenic or nonself-renewing phenotype (e.g., reduced cell growth rate, reduced cell division etc) or to induce the cell to enter a dormant cell phase (e.g., $G_0$ resting phase).

One of skill in the art will appreciate that the use of apoptosis-inducing techniques may require that the oncology-related polynucleotides, primary constructs or mmRNA are appropriately targeted to e.g., tumor cells to prevent unwanted wide-spread cell death. Thus, one can use a delivery mechanism (e.g., attached ligand or antibody, targeted liposome etc) that recognizes a cancer antigen such that the oncology-related polynucleotides, primary constructs or mmRNA are expressed only in cancer cells.

VI. KITS AND DEVICES

Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits comprising the molecules (oncology-related polynucleotides, oncology-related primary constructs or oncology-related mmRNA) of the invention. In one embodiment, the kit comprises one or more functional antibodies or function fragments thereof.

Said kits can be for oncology-related protein production, comprising a first oncology-related polynucleotide, oncology-related primary construct or oncology-related mmRNA comprising a translatable region. The kit may further comprise packaging and instructions and/or a delivery agent to form a formulation composition. The delivery agent may comprise a saline, a buffered solution, a lipidoid or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium. In a further embodiment, the buffer solutions may be precipitated or it may be lyophilized. The amount of each component may be varied to enable consistent, reproducible higher concentration saline or simple buffer formulations. The components may also be varied in order to increase the stability of modified RNA in the buffer solution over a period of time and/or under a variety of conditions. In one aspect, the present invention provides kits for oncology-related protein production, comprising: an oncology-related polynucleotide, oncology-related primary construct or oncology-related mmRNA comprising a translatable region, provided in an amount effective to produce a desired amount of an oncology-related protein encoded by the translatable region when introduced into a target cell; a second oncology-related polynucleotide comprising an inhibitory nucleic acid, provided in an amount effective to substantially inhibit the innate immune response of the cell; and packaging and instructions.

In one aspect, the present invention provides kits for oncology-related protein production, comprising an oncology-related polynucleotide, oncology-related primary construct or oncology-related mmRNA comprising a translatable region, wherein the oncology-related polynucleotide exhibits reduced degradation by a cellular nuclease, and packaging and instructions.

In one aspect, the present invention provides kits for oncology-related protein production, comprising an oncology-related polynucleotide, oncology-related primary construct or oncology-related mmRNA comprising a translatable region, wherein the oncology-related polynucleotide exhibits reduced degradation by a cellular nuclease, and a mammalian cell suitable for translation of the translatable region of the first nucleic acid.

In one embodiment, the levels of Protein C may be measured by immunoassay. The assay may be purchased and is available from any number of suppliers including BioMerieux, Inc. (Durham, N.C.), Abbott Laboratories (Abbott Park, Ill.), Siemens Medical Solutions USA, Inc. (Malvern, Pa.), BIOPORTO® Diagnostics A/S (Gentofte, Denmark), USCN® Life Science Inc. (Houston, Tex.) or Roche Diagnostic Corporation (Indianapolis, Ind.). In this embodiment, the assay may be used to assess levels of Protein C or its activated form or a variant delivered as or in response to administration of a modified mRNA molecule.

Devices

The present invention provides for devices which may incorporate oncology-related polynucleotides, oncology-related primary constructs or oncology-related mmRNA that encode oncology-related polypeptides of interest. These devices contain in a stable formulation the reagents to synthesize an oncology-related polynucleotide in a formulation available to be immediately delivered to a subject in need thereof, such as a human patient. Non-limiting examples of such a polypeptide of interest include a growth factor and/or angiogenesis stimulator for wound healing, a peptide antibiotic to facilitate infection control, and an antigen to rapidly stimulate an immune response to a newly identified virus.

Devices may also be used in conjunction with the present invention. In one embodiment, a device is used to assess levels of a protein which has been administered in the form of a modified mRNA. The device may comprise a blood, urine or other biofluidic test. It may be as large as to include an automated central lab platform or a small decentralized bench top device. It may be point of care or a handheld device. In this embodiment, for example, Protein C or APC may be quatitated before, during or after treatment with a modified mRNA encoding Protein C (its zymogen), APC or any variants thereof. Protein C, also known as autoprothrombin HA and blood coagulation factor XIV is a zymogen, or precursor, of a serine protease which plays an important role in the regulation of blood coagulation and generation of fibrinolytic activity in vivo. It is synthesized in the liver as a single-chain polypeptide but undergoes posttranslational processing to give rise to a two-chain intermediate. The intermediate form of Protein C is converted via thrombin-mediated cleavage of a 12-residue peptide from the amino-terminus of the heavy chain to of the molecule to the active form, known as "activated protein C" (APC). The device may be useful in drug discovery efforts as a companion diagnostic test associated with Protein C, or APC treatment such as for sepsis or severe sepsis. In early studies it was suggested that APC had the ability to reduce mortality in severe sepsis. Following this line of work, clinical studies lead to the FDA approval of one compound, activated drotrecogin alfa (recombinant protein C). However, in late 2011, the drug was withdrawn from sale in all markets following results of the PROWESS-SHOCK study, which showed the study did not meet the primary endpoint of a statistically significant reduction in 28-day all-cause mortality in patients with septic shock. The present invention provides modified mRNA molecules which may be used in the diagnosis and treatment of sepsis, severe sepsis and septicemia which overcome prior issues or problems associated with increasing protein expression efficiencies in mammals.

In some embodiments the device is self-contained, and is optionally capable of wireless remote access to obtain instructions for synthesis and/or analysis of the generated oncology-related polynucleotide, oncology-related primary construct or oncology-related mmRNA. The device is capable of mobile synthesis of at least one oncology-related polynucleotide, oncology-related primary construct or oncology-related mmRNA and preferably an unlimited number of different oncology-related polynucleotides, oncology-related primary constructs or oncology-related mmRNA. In certain embodiments, the device is capable of being transported by one or a small number of individuals. In other embodiments, the device is scaled to fit on a benchtop or desk. In other embodiments, the device is scaled to fit into a suitcase, backpack or similarly sized object. In another embodiment, the device may be a point of care or handheld device. In further embodiments, the device is scaled to fit into a vehicle, such as a car, truck or ambulance, or a military vehicle such as a tank or personnel carrier. The information necessary to generate a modified oncology-related mRNA encoding oncology-related polypeptide of interest is present within a computer readable medium present in the device.

In one embodiment, a device may be used to assess levels of an oncology-related protein which has been administered in the form of an oncology-related polynucleotide, oncology-related primary construct or oncology-related mmRNA. The device may comprise a blood, urine or other biofluidic test.

In some embodiments, the device is capable of communication (e.g., wireless communication) with a database of nucleic acid and polypeptide sequences which may be oncology-related nucleic acid and oncology-related polypeptide seqeunces. The device contains at least one sample block for insertion of one or more sample vessels. Such sample vessels are capable of accepting in liquid or other form any number of materials such as template DNA, nucleotides, enzymes, buffers, and other reagents. The sample vessels are also capable of being heated and cooled by contact with the sample block. The sample block is generally in communication with a device base with one or more electronic control units for the at least one sample block. The sample block preferably contains a heating module, such heating molecule capable of heating and/or cooling the sample vessels and contents thereof to temperatures between about −20 C and above +100 C. The device base is in communication with a voltage supply such as a battery or external voltage supply. The device also contains means for storing and distributing the materials for RNA synthesis.

Optionally, the sample block contains a module for separating the synthesized nucleic acids. Alternatively, the device contains a separation module operably linked to the sample block. Preferably the device contains a means for analysis of the synthesized nucleic acid. Such analysis includes sequence identity (demonstrated such as by hybridization), absence of non-desired sequences, measurement of integrity of synthesized mRNA (such has by microfluidic viscometry combined with spectrophotometry), and concentration and/or potency of modified RNA (such as by spectrophotometry).

In certain embodiments, the device is combined with a means for detection of pathogens present in a biological material obtained from a subject, e.g., the IBIS PLEX-ID system (Abbott, Abbott Park, Ill.) for microbial identification.

Suitable devices for use in delivering intradermal pharmaceutical compositions described herein include short needle devices such as those described in U.S. Pat. Nos. 4,886,499; 5,190,521; 5,328,483; 5,527,288; 4,270,537; 5,015,235; 5,141,496; and 5,417,662; each of which is herein incorporated by reference in their entirety. Intradermal compositions may be administered by devices which limit the effective penetration length of a needle into the skin, such as those described in PCT publication WO 99/34850 (herein incorporated by reference in its entirety) and functional equivalents thereof. Jet injection devices which deliver liquid compositions to the dermis via a liquid jet injector and/or via a needle which pierces the stratum corneum and produces a jet which reaches the dermis are suitable. Jet injection devices are described, for example, in U.S. Pat. Nos. 5,480,381; 5,599,302; 5,334,144; 5,993,412; 5,649,912; 5,569,189; 5,704,911; 5,383,851; 5,893,397; 5,466,220; 5,339,163; 5,312,335; 5,503,627; 5,064,413; 5,520,639; 4,596,556; 4,790,824; 4,941,880; 4,940,460; and PCT publications WO 97/37705 and WO 97/13537; each of which are hrein incorporated by reference in their entirety. Ballistic powder/particle delivery devices which use compressed gas to accelerate vaccine in powder form through the outer layers of the skin to the dermis are suitable. Alternatively or additionally, conventional syringes may be used in the classical mantoux method of intradermal administration.

In some embodiments, the device may be a pump or comprise a catheter for administration of compounds or compositions of the invention across the blood brain barrier. Such devices include but are not limited to a pressurized olfactory delivery device, iontophoresis devices, multi-layered microfluidic devices, and the like. Such devices may be portable or stationary. They may be implantable or externally tethered to the body or combinations thereof.

Devices for administration may be employed to deliver the oncology-related polynucleotides, oncology-related primary constructs or oncology-related mmRNA of the present invention according to single, multi- or split-dosing regimens taught herein. Such devices are described below.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

According to the present invention, these multi-administration devices may be utilized to deliver the single, multi- or split doses contemplated herein.

A method for delivering therapeutic agents to a solid tissue has been described by Bahrami et al. and is taught for example in US Patent Publication 20110230839, the contents of which are incorporated herein by reference in their entirety. According to Bahrami, an array of needles is incorporated into a device which delivers a substantially equal amount of fluid at any location in said solid tissue along each needle's length.

A device for delivery of biological material across the biological tissue has been described by Kodgule et al. and is taught for example in US Patent Publication 20110172610, the contents of which are incorporated herein by reference in their entirety. According to Kodgule, multiple hollow microneedles made of one or more metals and having outer diameters from about 200 microns to about 350 microns and lengths of at least 100 microns are incorporated into the device which delivers peptides, proteins, carbohydrates, nucleic acid molecules, lipids and other pharmaceutically active ingredients or combinations thereof.

A delivery probe for delivering a therapeutic agent to a tissue has been described by Gunday et al. and is taught for example in US Patent Publication 20110270184, the contents of each of which are incorporated herein by reference in their entirety. According to Gunday, multiple needles are incorporated into the device which moves the attached capsules between an activated position and an inactivated position to force the agent out of the capsules through the needles.

A multiple-injection medical apparatus has been described by Assaf and is taught for example in US Patent Publication 20110218497, the contents of which are incorporated herein by reference in their entirety. According to Assaf, multiple needles are incorporated into the device which has a chamber connected to one or more of said needles and a means for continuously refilling the chamber with the medical fluid after each injection.

In one embodiment, the oncology-related polynucleotide, oncology-related primary construct, or oncology-related mmRNA is administered subcutaneously or intramuscularly via at least 3 needles to three different, optionally adjacent, sites simultaneously, or within a 60 minutes period (e.g., administration to 4, 5, 6, 7, 8, 9, or sites simultaneously or within a 60 minute period). The split doses can be administered simultaneously to adjacent tissue using the devices described in U.S. Patent Publication Nos. 20110230839 and 20110218497, each of which is incorporated herein by reference in their entirety.

An at least partially implantable system for injecting a substance into a patient's body, in particular a penis erection stimulation system has been described by Forsell and is taught for example in US Patent Publication 20110196198, the contents of which are incorporated herein by reference in their entirety. According to Forsell, multiple needles are incorporated into the device which is implanted along with one or more housings adjacent the patient's left and right corpora cavernosa. A reservoir and a pump are also implanted to supply drugs through the needles.

A method for the transdermal delivery of a therapeutic effective amount of iron has been described by Berenson and is taught for example in US Patent Publication 20100130910, the contents of which are incorporated herein by reference in their entirety. According to Berenson, multiple needles may be used to create multiple micro channels in stratum corneum to enhance transdermal delivery of the ionic iron on an iontophoretic patch.

A method for delivery of biological material across the biological tissue has been described by Kodgule et al and is taught for example in US Patent Publication 20110196308, the contents of which are incorporated herein by reference in their entirety. According to Kodgule, multiple biodegradable microneedles containing a therapeutic active ingredient are incorporated in a device which delivers proteins, carbohydrates, nucleic acid molecules, lipids and other pharmaceutically active ingredients or combinations thereof.

A transdermal patch comprising a botulinum toxin composition has been described by Donovan and is taught for example in US Patent Publication 20080220020, the contents of which are incorporated herein by reference in their entirety. According to Donovan, multiple needles are incorporated into the patch which delivers botulinum toxin under stratum corneum through said needles which project through the stratum corneum of the skin without rupturing a blood vessel.

A small, disposable drug reservoir, or patch pump, which can hold approximately 0.2 to 15 mL of liquid formulations can be placed on the skin and deliver the formulation continuously subcutaneously using a small bore needed (e.g., 26 to 34 gauge). As non-limiting examples, the patch pump may be 50 mm by 76 mm by 20 mm spring loaded having a 30 to 34 gauge needle (BD™ Microinfuser, Franklin Lakes N.J.), 41 mm by 62 mm by 17 mm with a 2 mL reservoir used for drug delivery such as insulin (OMNIPOD®, Insulet Corporation Bedford, Mass.), or 43-60 mm diameter, 10 mm thick with a 0.5 to 10 mL reservoir (PATCHPUMP®, SteadyMed Therapeutics, San Francisco, Calif.). Further, the patch pump may be battery powered and/or rechargeable.

A cryoprobe for administration of an active agent to a location of cryogenic treatment has been described by Toubia and is taught for example in US Patent Publication 20080140061, the contents of which are incorporated herein by reference in their entirety. According to Toubia, multiple needles are incorporated into the probe which receives the active agent into a chamber and administers the agent to the tissue.

A method for treating or preventing inflammation or promoting healthy joints has been described by Stock et al and is taught for example in US Patent Publication 20090155186, the contents of which are incorporated herein by reference in their entirety. According to Stock, multiple needles are incorporated in a device which administers compositions containing signal transduction modulator compounds.

A multi-site injection system has been described by Kimmell et al. and is taught for example in US Patent Publication 20100256594, the contents of which are incorporated herein by reference in their entirety. According to Kimmell, multiple needles are incorporated into a device which delivers a medication into a stratum corneum through the needles.

A method for delivering interferons to the intradermal compartment has been described by Dekker et al. and is taught for example in US Patent Publication 20050181033, the contents of which are incorporated herein by reference in their entirety. According to Dekker, multiple needles having an outlet with an exposed height between 0 and 1 mm are incorporated into a device which improves pharmacokinetics and bioavailability by delivering the substance at a depth between 0.3 mm and 2 mm.

A method for delivering genes, enzymes and biological agents to tissue cells has described by Desai and is taught for example in US Patent Publication 20030073908, the contents of which are incorporated herein by reference in their entirety. According to Desai, multiple needles are incorporated into a device which is inserted into a body and delivers a medication fluid through said needles.

A method for treating cardiac arrhythmias with fibroblast cells has been described by Lee et al and is taught for example in US Patent Publication 20040005295, the contents of which are incorporated herein by reference in their entirety. According to Lee, multiple needles are incorporated into the device which delivers fibroblast cells into the local region of the tissue.

A method using a magnetically controlled pump for treating a brain tumor has been described by Shachar et al. and is taught for example in U.S. Pat. No. 7,799,012 (method) and U.S. Pat. No. 7,799,016 (device), the contents of which are incorporated herein by reference in their entirety. According Shachar, multiple needles were incorporated into the pump which pushes a medicating agent through the needles at a controlled rate.

Methods of treating functional disorders of the bladder in mammalian females have been described by Versi et al. and are taught for example in U.S. Pat. No. 8,029,496, the contents of which are incorporated herein by reference in their entirety. According to Versi, an array of micro-needles is incorporated into a device which delivers a therapeutic agent through the needles directly into the trigone of the bladder.

A micro-needle transdermal transport device has been described by Angel et al and is taught for example in U.S. Pat. No. 7,364,568, the contents of which are incorporated herein by reference in their entirety. According to Angel, multiple needles are incorporated into the device which transports a substance into a body surface through the needles which are inserted into the surface from different directions. The micro-needle transdermal transport device may be a solid micro-needle system or a hollow micro-needle system. As a non-limiting example, the solid micro-needle system may have up to a 0.5 mg capacity, with 300-1500 solid micro-needles per $cm^2$ about 150-700 lam tall coated with a drug. The micro-needles penetrate the stratum corneum and remain in the skin for short duration (e.g., 20 seconds to 15 minutes). In another example, the hollow micro-needle system has up to a 3 mL capacity to deliver liquid formulations using 15-20 microneedles per cm2 being approximately 950 µm tall. The micro-needles penetrate the skin to allow the liquid formulations to flow from the device into the skin. The hollow micro-needle system may be worn from 1 to 30 minutes depending on the formulation volume and viscosity.

A device for subcutaneous infusion has been described by Dalton et al and is taught for example in U.S. Pat. No. 7,150,726, the contents of which are incorporated herein by reference in their entirety. According to Dalton, multiple needles are incorporated into the device which delivers fluid through the needles into a subcutaneous tissue.

A device and a method for intradermal delivery of vaccines and gene therapeutic agents through microcannula have been described by Mikszta et al. and are taught for example in U.S. Pat. No. 7,473,247, the contents of which are incorporated herein by reference in their entirety. According to Mitszta, at least one hollow micro-needle is incorporated into the device which delivers the vaccines to the subject's skin to a depth of between 0.025 mm and 2 mm.

A method of delivering insulin has been described by Pettis et al and is taught for example in U.S. Pat. No. 7,722,595, the contents of which are incorporated herein by reference in their entirety. According to Pettis, two needles are incorporated into a device wherein both needles insert essentially simultaneously into the skin with the first at a depth of less than 2.5 mm to deliver insulin to intradermal compartment and the second at a depth of greater than 2.5 mm and less than 5.0 mm to deliver insulin to subcutaneous compartment.

Cutaneous injection delivery under suction has been described by Kochamba et al. and is taught for example in U.S. Pat. No. 6,896,666, the contents of which are incorporated herein by reference in their entirety. According to Kochamba, multiple needles in relative adjacency with each other are incorporated into a device which injects a fluid below the cutaneous layer.

A device for withdrawing or delivering a substance through the skin has been described by Down et al and is taught for example in U.S. Pat. No. 6,607,513, the contents of which are incorporated herein by reference in their entirety. According to Down, multiple skin penetrating members which are incorporated into the device have lengths of about 100 microns to about 2000 microns and are about 30 to 50 gauge.

A device for delivering a substance to the skin has been described by Palmer et al and is taught for example in U.S. Pat. No. 6,537,242, the contents of which are incorporated herein by reference in their entirety. According to Palmer, an array of micro-needles is incorporated into the device which uses a stretching assembly to enhance the contact of the needles with the skin and provides a more uniform delivery of the substance.

A perfusion device for localized drug delivery has been described by Zamoyski and is taught for example in U.S. Pat. No. 6,468,247, the contents of which are incorporated herein by reference in their entirety. According to Zamoyski, multiple hypodermic needles are incorporated into the device which injects the contents of the hypodermics into a tissue as said hypodermics are being retracted.

A method for enhanced transport of drugs and biological molecules across tissue by improving the interaction between micro-needles and human skin has been described by Prausnitz et al. and is taught for example in U.S. Pat. No. 6,743,211, the contents of which are incorporated herein by reference in their entirety. According to Prausnitz, multiple micro-needles are incorporated into a device which is able to present a more rigid and less deformable surface to which the micro-needles are applied.

A device for intraorgan administration of medicinal agents has been described by Ting et al and is taught for example in U.S. Pat. No. 6,077,251, the contents of which are incorporated herein by reference in their entirety. According to Ting, multiple needles having side openings for enhanced administration are incorporated into a device which by extending and retracting said needles from and into the needle chamber forces a medicinal agent from a reservoir into said needles and injects said medicinal agent into a target organ.

A multiple needle holder and a subcutaneous multiple channel infusion port has been described by Brown and is taught for example in U.S. Pat. No. 4,695,273, the contents of which are incorporated herein by reference in their entirety. According to Brown, multiple needles on the needle holder are inserted through the septum of the infusion port and communicate with isolated chambers in said infusion port.

A dual hypodermic syringe has been described by Horn and is taught for example in U.S. Pat. No. 3,552,394, the contents of which are incorporated herein by reference in their entirety. According to Horn, two needles incorporated into the device are spaced apart less than 68 mm and may be of different styles and lengths, thus enabling injections to be made to different depths.

A syringe with multiple needles and multiple fluid compartments has been described by Hershberg and is taught for example in U.S. Pat. No. 3,572,336, the contents of which are incorporated herein by reference in their entirety. According to Hershberg, multiple needles are incorporated into the syringe which has multiple fluid compartments and is capable of simultaneously administering incompatible drugs which are not able to be mixed for one injection.

A surgical instrument for intradermal injection of fluids has been described by Eliscu et al. and is taught for example in U.S. Pat. No. 2,588,623, the contents of which are incorporated herein by reference in their entirety. According to Eliscu, multiple needles are incorporated into the instrument which injects fluids intradermally with a wider disperse.

An apparatus for simultaneous delivery of a substance to multiple breast milk ducts has been described by Hung and is taught for example in EP 1818017, the contents of which are incorporated herein by reference in their entirety. According to Hung, multiple lumens are incorporated into the device which inserts though the orifices of the ductal networks and delivers a fluid to the ductal networks.

A catheter for introduction of medications to the tissue of a heart or other organs has been described by Tkebuchava and is taught for example in WO2006138109, the contents of which are incorporated herein by reference in their entirety. According to Tkebuchava, two curved needles are incorporated which enter the organ wall in a flattened trajectory.

Devices for delivering medical agents have been described by Mckay et al. and are taught for example in WO2006118804, the content of which are incorporated herein by reference in their entirety. According to Mckay, multiple needles with multiple orifices on each needle are incorporated into the devices to facilitate regional delivery to a tissue, such as the interior disc space of a spinal disc.

A method for directly delivering an immunomodulatory substance into an intradermal space within a mammalian skin has been described by Pettis and is taught for example in WO2004020014, the contents of which are incorporated herein by reference in their entirety. According to Pettis, multiple needles are incorporated into a device which delivers the substance through the needles to a depth between 0.3 mm and 2 mm.

Methods and devices for administration of substances into at least two compartments in skin for systemic absorption and improved pharmacokinetics have been described by Pettis et al. and are taught for example in WO2003094995, the contents of which are incorporated herein by reference in their entirety. According to Pettis, multiple needles having lengths between about 300 µm and about 5 mm are incorporated into a device which delivers to intradermal and subcutaneous tissue compartments simultaneously.

A drug delivery device with needles and a roller has been described by Zimmerman et al. and is taught for example in WO2012006259, the contents of which are incorporated herein by reference in their entirety. According to Zimmerman, multiple hollow needles positioned in a roller are incorporated into the device which delivers the content in a reservoir through the needles as the roller rotates.

A drug delivery device such as a stent is known in the art and is taught for example in U.S. Pat. No. 8,333,799, U.S. Pub. Nos. US20060020329, US20040172127 and US20100161032; the contents of each of which are herein incorporated by reference in their entirety. Formulations of the polynucleotides, primary constructs, mmRNA described herein may be delivered using stents. Additionally, stents used herein may be able to deliver multiple polynucleotides, primary constructs and/or mmRNA and/or formulations at the same or varied rates of delivery. Non-limiting examples of manufacturers of stents include CORDIS® (Miami, Fla.) (CYPHER®), Boston Scientific Corporation (Natick, Mass.) (TAXUS®), Medtronic (Minneapolis, Minn.) (ENDEAVOUR®) and Abbott (Abbott Park, Ill.) (XIENCE V®).

Methods and Devices Utilizing Catheters and/or Lumens

Methods and devices using catheters and lumens may be employed to administer the oncology-related mmRNA of the present invention on a single, multi- or split dosing schedule. Such methods and devices are described below.

A catheter-based delivery of skeletal myoblasts to the myocardium of damaged hearts has been described by Jacoby et al and is taught for example in US Patent Publication 20060263338, the contents of which are incorporated herein by reference in their entirety. According to Jacoby, multiple needles are incorporated into the device at least part of which is inserted into a blood vessel and delivers the cell composition through the needles into the localized region of the subject's heart.

An apparatus for treating asthma using neurotoxin has been described by Deem et al and is taught for example in US Patent Publication 20060225742, the contents of which are incorporated herein by reference in their entirety. According to Deem, multiple needles are incorporated into the device which delivers neurotoxin through the needles into the bronchial tissue.

A method for administering multiple-component therapies has been described by Nayak and is taught for example in U.S. Pat. No. 7,699,803, the contents of which are incorporated herein by reference in their entirety. According to Nayak, multiple injection cannulas may be incorporated into a device wherein depth slots may be included for controlling the depth at which the therapeutic substance is delivered within the tissue.

A surgical device for ablating a channel and delivering at least one therapeutic agent into a desired region of the tissue has been described by McIntyre et al and is taught for example in U.S. Pat. No. 8,012,096, the contents of which are incorporated herein by reference in their entirety. According to McIntyre, multiple needles are incorporated into the device which dispenses a therapeutic agent into a region of tissue surrounding the channel and is particularly well suited for transmyocardial revascularization operations.

Methods of treating functional disorders of the bladder in mammalian females have been described by Versi et al and are taught for example in U.S. Pat. No. 8,029,496, the contents of which are incorporated herein by reference in their entirety. According to Versi, an array of micro-needles is incorporated into a device which delivers a therapeutic agent through the needles directly into the trigone of the bladder.

A device and a method for delivering fluid into a flexible biological barrier have been described by Yeshurun et al. and are taught for example in U.S. Pat. No. 7,998,119 (device) and 8,007,466 (method), the contents of which are incorporated herein by reference in their entirety. According to Yeshurun, the micro-needles on the device penetrate and extend into the flexible biological barrier and fluid is injected through the bore of the hollow micro-needles.

A method for epicardially injecting a substance into an area of tissue of a heart having an epicardial surface and disposed within a torso has been described by Bonner et al and is taught for example in U.S. Pat. No. 7,628,780, the contents of which are incorporated herein by reference in their entirety. According to Bonner, the devices have elongate shafts and distal injection heads for driving needles into tissue and injecting medical agents into the tissue through the needles.

A device for sealing a puncture has been described by Nielsen et al and is taught for example in U.S. Pat. No. 7,972,358, the contents of which are incorporated herein by reference in their entirety. According to Nielsen, multiple needles are incorporated into the device which delivers a closure agent into the tissue surrounding the puncture tract.

A method for myogenesis and angiogenesis has been described by Chiu et al. and is taught for example in U.S. Pat. No. 6,551,338, the contents of which are incorporated herein by reference in their entirety. According to Chiu, 5 to 15 needles having a maximum diameter of at least 1.25 mm and a length effective to provide a puncture depth of 6 to 20 mm are incorporated into a device which inserts into proximity with a myocardium and supplies an exogeneous angiogenic or myogenic factor to said myocardium through the conduits which are in at least some of said needles.

A method for the treatment of prostate tissue has been described by Bolmsj et al. and is taught for example in U.S. Pat. No. 6,524,270, the contents of which are incorporated herein by reference in their entirety. According to Bolmsj, a device comprising a catheter which is inserted through the urethra has at least one hollow tip extendible into the surrounding prostate tissue. An astringent and analgesic medicine is administered through said tip into said prostate tissue.

A method for infusing fluids to an intraosseous site has been described by Findlay et al. and is taught for example in U.S. Pat. No. 6,761,726, the contents of which are incorporated herein by reference in their entirety. According to Findlay, multiple needles are incorporated into a device which is capable of penetrating a hard shell of material covered by a layer of soft material and delivers a fluid at a predetermined distance below said hard shell of material.

A device for injecting medications into a vessel wall has been described by Vigil et al. and is taught for example in U.S. Pat. No. 5,713,863, the contents of which are incorporated herein by reference in their entirety. According to Vigil, multiple injectors are mounted on each of the flexible tubes in the device which introduces a medication fluid through a multi-lumen catheter, into said flexible tubes and out of said injectors for infusion into the vessel wall.

A catheter for delivering therapeutic and/or diagnostic agents to the tissue surrounding a bodily passageway has been described by Faxon et al. and is taught for example in U.S. Pat. No. 5,464,395, the contents of which are incorporated herein by reference in their entirety. According to Faxon, at least one needle cannula is incorporated into the catheter which delivers the desired agents to the tissue through said needles which project outboard of the catheter.

Balloon catheters for delivering therapeutic agents have been described by Orr and are taught for example in WO2010024871, the contents of which are incorporated herein by reference in their entirety. According to Orr, multiple needles are incorporated into the devices which deliver the therapeutic agents to different depths within the tissue. In another aspect, drug-eluting balloons may be used to deliver the formulations described herein. The drug-eluting balloons may be used in target lesion applications such as, but are not limited to, in-stent restenosis, treating lesion in tortuous vessels, bifurcation lesions, femoral/popliteal lesions and below the knee lesions.

A device for delivering therapeutic agents (e.g., oncology-related polynucleotides, primary constructs or mmRNA) to tissue disposed about a lumin has been described by Perry et al. and is taught for example in U.S. Pat. Pub. US20100125239, the contents of which are herein incorporated by reference in their entirety. According to Perry, the catheter has a balloon which may be coated with a therapeutic agent by methods known in the art and described in Perry. When the balloon expands, the therapeutic agent will contact the surrounding tissue. The device may additionally have a heat source to change the temperature of the coating on the balloon to release the therapeutic agent to the tissue.

Methods and Devices Utilizing Electrical Current

Methods and devices utilizing electric current may be employed to deliver the mmRNA of the present invention according to the single, multi- or split dosing regimens taught herein. Such methods and devices are described below.

An electro collagen induction therapy device has been described by Marquez and is taught for example in US Patent Publication 20090137945, the contents of which are incorporated herein by reference in their entirety. According to Marquez, multiple needles are incorporated into the device which repeatedly pierce the skin and draw in the skin a portion of the substance which is applied to the skin first.

An electrokinetic system has been described by Etheredge et al. and is taught for example in US Patent Publication 20070185432, the contents of which are incorporated herein by reference in their entirety. According to Etheredge, micro-needles are incorporated into a device which drives by an electrical current the medication through the needles into the targeted treatment site.

An iontophoresis device has been described by Matsumura et al. and is taught for example in U.S. Pat. No. 7,437,189, the contents of which are incorporated herein by reference in their entirety. According to Matsumura, multiple needles are incorporated into the device which is capable of delivering ionizable drug into a living body at higher speed or with higher efficiency.

Intradermal delivery of biologically active agents by needle-free injection and electroporation has been described by Hoffmann et al and is taught for example in U.S. Pat. No. 7,171,264, the contents of which are incorporated herein by reference in their entirety. According to Hoffmann, one or more needle-free injectors are incorporated into an electroporation device and the combination of needle-free injection and electroporation is sufficient to introduce the agent into cells in skin, muscle or mucosa.

A method for electropermeabilization-mediated intracellular delivery has been described by Lundkvist et al. and is taught for example in U.S. Pat. No. 6,625,486, the contents of which are incorporated herein by reference in their entirety. According to Lundkvist, a pair of needle electrodes is incorporated into a catheter. Said catheter is positioned into a body lumen followed by extending said needle electrodes to penetrate into the tissue surrounding said lumen. Then the device introduces an agent through at least one of said needle electrodes and applies electric field by said pair of needle electrodes to allow said agent pass through the cell membranes into the cells at the treatment site.

A delivery system for transdermal immunization has been described by Levin et al. and is taught for example in WO2006003659, the contents of which are incorporated herein by reference in their entirety. According to Levin, multiple electrodes are incorporated into the device which applies electrical energy between the electrodes to generate micro channels in the skin to facilitate transdermal delivery.

A method for delivering RF energy into skin has been described by Schomacker and is taught for example in WO2011163264, the contents of which are incorporated herein by reference in their entirety. According to Schomacker, multiple needles are incorporated into a device which applies vacuum to draw skin into contact with a plate so that needles insert into skin through the holes on the plate and deliver RF energy.

VII. DEFINITIONS

At various places in the present specification, substituents of compounds of the present disclosure are disclosed in groups or in ranges. It is specifically intended that the present disclosure include each and every individual subcombination of the members of such groups and ranges. For example, the term "$C_{1-6}$ alkyl" is specifically intended to individually disclose methyl, ethyl, $C_3$ alkyl, $C_4$ alkyl, $C_5$ alkyl, and $C_6$ alkyl.

About: As used herein, the term "about" means+/−10% of the recited value.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigens of interest or desired antigens: As used herein, the terms "antigens of interest" or "desired antigens" include those proteins and other biomolecules provided herein that are immunospecifically bound by the antibodies and fragments, mutants, variants, and alterations thereof described herein. Examples of antigens of interest include, but are not limited to, insulin, insulin-like growth factor, hGH, tPA, cytokines, such as interleukins (IL), e.g., IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, interferon (IFN) alpha, IFN beta, IFN gamma, IFN omega or IFN tau, tumor necrosis factor (TNF), such as TNF alpha and TNF beta, TNF gamma, TRAIL; G-CSF, GM-CSF, M-CSF, MCP-1 and VEGF.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may effect the same outcome or a different outcome. The structure that produces the function may be the same or different. For example, bifunctional modified RNAs of the present invention may encode a cytotoxic peptide (a first function) while those nucleosides which comprise the encoding RNA are, in and of themselves, cytotoxic (second function). In this example, delivery of the bifunctional modified RNA to a cancer cell would produce not only a peptide or protein molecule which may ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, an oncology-related polynucleotide, oncology-related primary construct or oncology-related mmRNA of the present invention may be considered biologically active if even a portion of the oncology-related polynucleotide, oncology-related primary construct or oncology-related mmRNA is biologically active or mimics an activity considered biologically relevant.

Cancer: As used herein, the term "cancer" in a subject refers to the presence of cells possessing characteristics, such as uncontrolled proliferation, immortality, metastatic potential, rapid growth and proliferation rate, and certain characteristic morphological features. Often, cancer cells will be in the form of a tumor, but such cells may exist alone within a subject, or may circulate in the blood stream as independent cells, such as leukemic cells.

Cell growth: As used herein, the term "cell growth" is principally associated with growth in cell numbers, which occurs by means of cell reproduction (i.e. proliferation) when the rate of the latter is greater than the rate of cell death (e.g. by apoptosis or necrosis).

Chemical terms: The following provides the definition of various chemical terms from "acyl" to "thiol."

The term "acyl," as used herein, represents a hydrogen or an alkyl group (e.g., a haloalkyl group), as defined herein, that is attached to the parent molecular group through a carbonyl group, as defined herein, and is exemplified by formyl (i.e., a carboxyaldehyde group), acetyl, propionyl, butanoyl and the like. Exemplary unsubstituted acyl groups include from 1 to 7, from 1 to 11, or from 1 to 21 carbons. In some embodiments, the alkyl group is further substituted with 1, 2, 3, or 4 substituents as described herein.

The term "acylamino," as used herein, represents an acyl group, as defined herein, attached to the parent molecular group though an amino group, as defined herein (i.e., —N($R^{N1}$)—C(O)—R, where R is H or an optionally substituted $C_{1-6}$, $C_{1-10}$, or $C_{1-20}$ alkyl group and $R^{N1}$ is as defined herein). Exemplary unsubstituted acylamino groups include from 1 to 41 carbons (e.g., from 1 to 7, from 1 to 13, from 1 to 21, from 2 to 7, from 2 to 13, from 2 to 21, or from 2 to 41 carbons). In some embodiments, the alkyl group is further substituted with 1, 2, 3, or 4 substituents as described herein, and/or the amino group is —$NH_2$ or —$NHR^{N1}$, wherein $R^{N1}$ is, independently, OH, $NO_2$, $NH_2$, $NR^{N2}_2$, $SO_2OR^{N2}$, $SO_2R^{N2}$, $SOR^{N2}$, alkyl, or aryl, and each $R^{N2}$ can be H, alkyl, or aryl.

The term "acyloxy," as used herein, represents an acyl group, as defined herein, attached to the parent molecular group though an oxygen atom (i.e., —O—C(O)—R, where R is H or an optionally substituted $C_{1-6}$, $C_{1-10}$, or $C_{1-20}$ alkyl group). Exemplary unsubstituted acyloxy groups include from 1 to 21 carbons (e.g., from 1 to 7 or from 1 to 11 carbons). In some embodiments, the alkyl group is further substituted with 1, 2, 3, or 4 substituents as described herein, and/or the amino group is —$NH_2$ or —$NHR^{N1}$, wherein $R^{N1}$ is, independently, OH, $NO_2$, $NH_2$, $NR^{N2}_2$, $SO_2OR^{N2}$, $SO_2R^{N2}$, $SOR^{N2}$, alkyl, or aryl, and each $R^{N2}$ can be H, alkyl, or aryl.

The term "alkaryl," as used herein, represents an aryl group, as defined herein, attached to the parent molecular group through an alkylene group, as defined herein. Exemplary unsubstituted alkaryl groups are from 7 to 30 carbons (e.g., from 7 to 16 or from 7 to 20 carbons, such as $C_{1-6}$ alk-$C_{6-10}$ aryl, $C_{1-10}$ alk-$C_{6-10}$ aryl, or $C_{1-20}$ alk-$C_{6-10}$ aryl). In some embodiments, the alkylene and the aryl each can be further substituted with 1, 2, 3, or 4 substituent groups as defined herein for the respective groups. Other groups preceded by the prefix "alk-" are defined in the same manner, where "alk" refers to a $C_{1-6}$ alkylene, unless otherwise noted, and the attached chemical structure is as defined herein.

The term "alkcycloalkyl" represents a cycloalkyl group, as defined herein, attached to the parent molecular group through an alkylene group, as defined herein (e.g., an alkylene group of from 1 to 4, from 1 to 6, from 1 to 10, or form 1 to 20 carbons). In some embodiments, the alkylene and the cycloalkyl each can be further substituted with 1, 2, 3, or 4 substituent groups as defined herein for the respective group.

The term "alkenyl," as used herein, represents monovalent straight or branched chain groups of, unless otherwise specified, from 2 to 20 carbons (e.g., from 2 to 6 or from 2 to 10 carbons) containing one or more carbon-carbon double bonds and is exemplified by ethenyl, 1-propenyl, 2-propenyl, 2-methyl-1-propenyl, 1-butenyl, 2-butenyl, and the like. Alkenyls include both cis and trans isomers. Alkenyl groups may be optionally substituted with 1, 2, 3, or 4 substituent groups that are selected, independently, from amino, aryl, cycloalkyl, or heterocyclyl (e.g., heteroaryl), as defined herein, or any of the exemplary alkyl substituent groups described herein.

The term "alkenyloxy" represents a chemical substituent of formula —OR, where R is a $C_{2-20}$ alkenyl group (e.g., $C_{2-6}$ or $C_{2-10}$ alkenyl), unless otherwise specified. Exemplary alkenyloxy groups include ethenyloxy, propenyloxy, and the like. In some embodiments, the alkenyl group can be further substituted with 1, 2, 3, or 4 substituent groups as defined herein (e.g., a hydroxy group).

The term "alkheteroaryl" refers to a heteroaryl group, as defined herein, attached to the parent molecular group through an alkylene group, as defined herein. Exemplary unsubstituted alkheteroaryl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heteroaryl, $C_{1-10}$ alk-$C_{1-12}$ heteroaryl, or $C_{1-20}$ alk-$C_{1-12}$ heteroaryl). In some embodiments, the alkylene and the heteroaryl each can be further substituted with 1, 2, 3, or 4 substituent groups as defined herein for the respective group. Alkheteroaryl groups are a subset of alkheterocyclyl groups.

The term "alkheterocyclyl" represents a heterocyclyl group, as defined herein, attached to the parent molecular group through an alkylene group, as defined herein. Exemplary unsubstituted alkheterocyclyl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heterocyclyl, $C_{1-10}$ alk-$C_{1-12}$ heterocyclyl, or $C_{1-20}$ alk-$C_{1-12}$ heterocyclyl). In some embodiments, the alkylene and the heterocyclyl each can be further substituted with 1, 2, 3, or 4 substituent groups as defined herein for the respective group.

The term "alkoxy" represents a chemical substituent of formula —OR, where R is a $C_{1-20}$ alkyl group (e.g., $C_{1-6}$ or $C_{1-10}$ alkyl), unless otherwise specified. Exemplary alkoxy groups include methoxy, ethoxy, propoxy (e.g., n-propoxy and isopropoxy), t-butoxy, and the like. In some embodiments, the alkyl group can be further substituted with 1, 2, 3, or 4 substituent groups as defined herein (e.g., hydroxy or alkoxy).

The term "alkoxyalkoxy" represents an alkoxy group that is substituted with an alkoxy group. Exemplary unsubstituted alkoxyalkoxy groups include between 2 to 40 carbons (e.g., from 2 to 12 or from 2 to 20 carbons, such as $C_{1-6}$ alkoxy-$C_{1-6}$ alkoxy, $C_{1-10}$ alkoxy-$C_{1-10}$ alkoxy, or $C_{1-20}$ alkoxy-$C_{1-20}$ alkoxy). In some embodiments, the each alkoxy group can be further substituted with 1, 2, 3, or 4 substituent groups as defined herein.

The term "alkoxyalkyl" represents an alkyl group that is substituted with an alkoxy group. Exemplary unsubstituted alkoxyalkyl groups include between 2 to 40 carbons (e.g., from 2 to 12 or from 2 to 20 carbons, such as $C_{1-6}$ alkoxy-$C_{1-6}$ alkyl, $C_{1-10}$ alkoxy-$C_{1-10}$ alkyl, or $C_{1-20}$ alkoxy-$C_{1-20}$ alkyl). In some embodiments, the alkyl and the alkoxy each can be further substituted with 1, 2, 3, or 4 substituent groups as defined herein for the respective group.

The term "alkoxycarbonyl," as used herein, represents an alkoxy, as defined herein, attached to the parent molecular group through a carbonyl atom (e.g., —C(O)—OR, where R is H or an optionally substituted $C_{1-6}$, $C_{1-10}$, or $C_{1-20}$ alkyl group). Exemplary unsubstituted alkoxycarbonyl include from 1 to 21 carbons (e.g., from 1 to 11 or from 1 to 7 carbons). In some embodiments, the alkoxy group is further substituted with 1, 2, 3, or 4 substituents as described herein.

The term "alkoxycarbonylalkoxy," as used herein, represents an alkoxy group, as defined herein, that is substituted with an alkoxycarbonyl group, as defined herein (e.g., —O-alkyl-C(O)—OR, where R is an optionally substituted $C_{1-6}$, $C_{1-10}$, or $C_{1-20}$ alkyl group). Exemplary unsubstituted alkoxycarbonylalkoxy include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkoxy, $C_{1-10}$ alkoxycarbonyl-$C_{1-10}$ alkoxy, or $C_{1-20}$ alkoxycarbonyl-$C_{1-20}$ alkoxy). In some embodiments, each alkoxy group is further independently substituted with 1, 2, 3, or 4 substituents, as described herein (e.g., a hydroxy group).

The term "alkoxycarbonylalkyl," as used herein, represents an alkyl group, as defined herein, that is substituted with an alkoxycarbonyl group, as defined herein (e.g., -alkyl-C(O)—OR, where R is an optionally substituted $C_{1-20}$, $C_{1-10}$, or $C_{1-6}$ alkyl group). Exemplary unsubstituted alkoxycarbonylalkyl include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkyl, $C_{1-10}$ alkoxycarbonyl-$C_{1-10}$ alkyl, or $C_{1-20}$ alkoxycarbonyl-$C_{1-20}$ alkyl). In some embodiments, each alkyl and alkoxy group is further independently substituted with 1, 2, 3, or 4 substituents as described herein (e.g., a hydroxy group).

The term "alkyl," as used herein, is inclusive of both straight chain and branched chain saturated groups from 1 to 20 carbons (e.g., from 1 to 10 or from 1 to 6), unless otherwise specified. Alkyl groups are exemplified by methyl, ethyl, n- and isopropyl, n-, sec-, iso- and tert-butyl, neopentyl, and the like, and may be optionally substituted with one, two, three, or, in the case of alkyl groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —NH$_2$) or a substituted amino (i.e., —N(R$^{N1}$)$_2$, where R$^{N1}$ is as defined for amino); (4) $C_{6-10}$ aryl-$C_{1-6}$ alkoxy; (5) azido; (6) halo; (7) ($C_{2-9}$heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) —CO$_2$R$^{A'}$, where R$^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (15) —C(O)NR$^{B'}$R$^{C'}$, where each of R$^{B'}$ and R$^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —SO$_2$R$^{D'}$, where R$^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —SO$_2$NR$^{E'}$R$^{F'}$, where each of R$^{E'}$ and R$^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) —C(O)R$^{G'}$, where R$^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (19) —NR$^{H'}$C(O)R$^{I'}$, wherein R$^{H'}$ is selected from the group consisting of (a1) hydrogen and (b1) $C_{1-6}$ alkyl, and R$^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (20) —NR$^{J'}$C(O)OR$^{K'}$, wherein R$^{J'}$ is selected from the group consisting of (a1) hydrogen and (b1) $C_{1-6}$ alkyl, and R$^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; and (21) amidine. In some embodiments, each of these groups can be further substituted as described herein. For example, the alkylene group of a $C_1$-alkaryl can be further substituted with an oxo group to afford the respective aryloyl substituent.

The term "alkylene" and the prefix "alk-," as used herein, represent a saturated divalent hydrocarbon group derived from a straight or branched chain saturated hydrocarbon by the removal of two hydrogen atoms, and is exemplified by methylene, ethylene, isopropylene, and the like. The term "$C_{x-y}$ alkylene" and the prefix "$C_{x-y}$ alk-" represent alkylene groups having between x and y carbons. Exemplary values for x are 1, 2, 3, 4, 5, and 6, and exemplary values for y are 2, 3, 4, 5, 6, 7, 8, 9, 10, 12, 14, 16, 18, or 20 (e.g., $C_{1-6}$, $C_{1-10}$, $C_{2-20}$, $C_{2-6}$, $C_{2-10}$, or $C_{2-20}$ alkylene). In some embodiments, the alkylene can be further substituted with 1, 2, 3, or 4 substituent groups as defined herein for an alkyl group.

The term "alkylsulfinyl," as used herein, represents an alkyl group attached to the parent molecular group through an —S(O)— group. Exemplary unsubstituted alkylsulfinyl groups are from 1 to 6, from 1 to 10, or from 1 to 20 carbons. In some embodiments, the alkyl group can be further substituted with 1, 2, 3, or 4 substituent groups as defined herein.

The term "alkylsulfinylalkyl," as used herein, represents an alkyl group, as defined herein, substituted by an alkylsulfinyl group. Exemplary unsubstituted alkylsulfinylalkyl groups are from 2 to 12, from 2 to 20, or from 2 to 40 carbons. In some embodiments, each alkyl group can be further substituted with 1, 2, 3, or 4 substituent groups as defined herein.

The term "alkynyl," as used herein, represents monovalent straight or branched chain groups from 2 to 20 carbon atoms (e.g., from 2 to 4, from 2 to 6, or from 2 to 10 carbons) containing a carbon-carbon triple bond and is exemplified by ethynyl, 1-propynyl, and the like. Alkynyl groups may be optionally substituted with 1, 2, 3, or 4 substituent groups that are selected, independently, from aryl, cycloalkyl, or heterocyclyl (e.g., heteroaryl), as defined herein, or any of the exemplary alkyl substituent groups described herein.

The term "alkynyloxy" represents a chemical substituent of formula —OR, where R is a $C_{2-20}$ alkynyl group (e.g., $C_{2-6}$ or $C_{2-10}$ alkynyl), unless otherwise specified. Exemplary alkynyloxy groups include ethynyloxy, propynyloxy, and the like. In some embodiments, the alkynyl group can be further substituted with 1, 2, 3, or 4 substituent groups as defined herein (e.g., a hydroxy group).

The term "amidine," as used herein, represents a —C(=NH)NH$_2$ group.

The term "amino," as used herein, represents —N(R$^{N1}$)$_2$, wherein each R$^{N1}$ is, independently, H, OH, NO$_2$, N(R$^{N2}$)$_2$, SO$_2$OR$^{N2}$, SO$_2$R$^{N2}$, SOR$^{N2}$, an N-protecting group, alkyl, alkenyl, alkynyl, alkoxy, aryl, alkaryl, cycloalkyl, alkcycloalkyl, carboxyalkyl, sulfoalkyl, heterocyclyl (e.g., heteroaryl), or alkheterocyclyl (e.g., alkheteroaryl), wherein each of these recited R$^{N1}$ groups can be optionally substituted, as defined herein for each group; or two R$^{N1}$ combine to form a heterocyclyl or an N-protecting group, and wherein each R$^{N2}$ is, independently, H, alkyl, or aryl. The amino groups of the invention can be an unsubstituted amino (i.e., —NH$_2$) or a substituted amino (i.e., —N(R$^{N1}$)$_2$). In a preferred embodiment, amino is —NH$_2$ or —NHR$^{N1}$, wherein R$^{N1}$ is, independently, OH, NO$_2$, NH$_2$, NR$^{N2}$2, SO$_2$OR$^{N2}$, SO$_2$R$^{N2}$, SOR$^{N2}$, alkyl, carboxyalkyl, sulfoalkyl, or aryl, and each R$^{N2}$ can be H, $C_{1-20}$ alkyl (e.g., $C_{1-6}$ alkyl), or $C_{6-10}$ aryl.

The term "amino acid," as described herein, refers to a molecule having a side chain, an amino group, and an acid group (e.g., a carboxy group of —CO$_2$H or a sulfo group of —SO$_3$H), wherein the amino acid is attached to the parent molecular group by the side chain, amino group, or acid group (e.g., the side chain). In some embodiments, the amino acid is attached to the parent molecular group by a carbonyl group, where the side chain or amino group is attached to the carbonyl group. Exemplary side chains include an optionally substituted alkyl, aryl, heterocyclyl, alkaryl, alkheterocyclyl, aminoalkyl, carbamoylalkyl, and carboxyalkyl. Exemplary amino acids include alanine, arginine, asparagine, aspartic acid, cysteine, glutamic acid, glutamine, glycine, histidine, hydroxynorvaline, isoleucine, leucine, lysine, methionine, norvaline, ornithine, phenylalanine, proline, pyrrolysine, selenocysteine, serine, taurine, threonine, tryptophan, tyrosine, and valine. Amino acid groups may be optionally substituted with one, two, three, or, in the case of amino acid groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —NH$_2$) or a substituted amino (i.e., —N(R$^{N1}$)$_2$, where R$^{N1}$ is as defined for amino); (4) $C_{6-10}$ aryl-$C_{1-6}$ alkoxy; (5) azido; (6) halo; (7) ($C_{2-9}$ heterocyclyl) oxy; (8) hydroxy; (9) nitro; (10) oxo (e.g., carboxyaldehyde or acyl); (11) $C_{1-7}$ spirocyclyl; (12) thioalkoxy; (13) thiol; (14) —CO$_2$R$^{A'}$, where R$^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (15) —C(O)NR$^{B'}$R$^{C'}$, where each of R$^{B'}$ and R$^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —SO$_2$R$^{D'}$, where R$^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —SO$_2$NR$^{E'}$R$^{F'}$, where each of R$^{E'}$ and R$^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) —C(O)R$^{G'}$, where R$^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted $C_{1-6}$ alkyl; (19) —NR$^{H'}$C(O)R$^{I'}$, wherein R$^{H'}$ is selected from the group consisting of (a1) hydrogen and (b1) $C_{1-6}$ alkyl, and R$^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —$NR^{J'}C(O)OR^{K'}$, wherein $R^{J'}$ is selected from the group consisting of (a1) hydrogen and (b1) $C_{1-6}$ alkyl, and $R^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein.

The term "aminoalkoxy," as used herein, represents an alkoxy group, as defined herein, substituted by an amino group, as defined herein. The alkyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The term "aminoalkyl," as used herein, represents an alkyl group, as defined herein, substituted by an amino group, as defined herein. The alkyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The term "aryl," as used herein, represents a mono-, bicyclic, or multicyclic carbocyclic ring system having one or two aromatic rings and is exemplified by phenyl, naphthyl, 1,2-dihydronaphthyl, 1,2,3,4-tetrahydronaphthyl, anthracenyl, phenanthrenyl, fluorenyl, indanyl, indenyl, and the like, and may be optionally substituted with 1, 2, 3, 4, or 5 substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —$(CH_2)_qCO_2R^{A'}$, where q is an integer from zero to four, and $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —$(CH_2)_qCONR^{B'}R^{C'}$, where q is an integer from zero to four and where $R^{B'}$ and $R^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —$(CH_2)_qSO_2R^{D'}$, where q is an integer from zero to four and where $R^{D'}$ is selected from the group consisting of (a) alkyl, (b) $C_{6-10}$ aryl, and (c) alk-$C_{6-10}$ aryl; (20) —$(CH_2)_qSO_2NR^{E'}R^{F'}$, where q is an integer from zero to four and where each of $R^{E'}$ and $R^{F'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) $C_{6-10}$ aryl-$C_{1-6}$ alkoxy; (25) $C_{1-6}$ alk-$C_{1-12}$ heterocyclyl (e.g., $C_{1-6}$ alk-$C_{1-12}$ heteroaryl); (26) $C_{2-20}$ alkenyl; and (27) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The term "arylalkoxy," as used herein, represents an alkaryl group, as defined herein, attached to the parent molecular group through an oxygen atom. Exemplary unsubstituted alkoxyalkyl groups include from 7 to 30 carbons (e.g., from 7 to 16 or from 7 to 20 carbons, such as $C_{6-10}$ aryl-$C_{1-6}$ alkoxy, $C_{6-10}$ aryl-$C_{1-10}$ alkoxy, or $C_{6-10}$ aryl-$C_{1-20}$ alkoxy). In some embodiments, the arylalkoxy group can be substituted with 1, 2, 3, or 4 substituents as defined herein The term "aryloxy" represents a chemical substituent of formula —OR', where R' is an aryl group of 6 to 18 carbons, unless otherwise specified. In some embodiments, the aryl group can be substituted with 1, 2, 3, or 4 substituents as defined herein.

The term "aryloyl," as used herein, represents an aryl group, as defined herein, that is attached to the parent molecular group through a carbonyl group. Exemplary unsubstituted aryloyl groups are of 7 to 11 carbons. In some embodiments, the aryl group can be substituted with 1, 2, 3, or 4 substituents as defined herein.

The term "azido" represents an —$N_3$ group, which can also be represented as —N=N=N.

The term "bicyclic," as used herein, refer to a structure having two rings, which may be aromatic or non-aromatic. Bicyclic structures include spirocyclyl groups, as defined herein, and two rings that share one or more bridges, where such bridges can include one atom or a chain including two, three, or more atoms. Exemplary bicyclic groups include a bicyclic carbocyclyl group, where the first and second rings are carbocyclyl groups, as defined herein; a bicyclic aryl groups, where the first and second rings are aryl groups, as defined herein; bicyclic heterocyclyl groups, where the first ring is a heterocyclyl group and the second ring is a carbocyclyl (e.g., aryl) or heterocyclyl (e.g., heteroaryl) group; and bicyclic heteroaryl groups, where the first ring is a heteroaryl group and the second ring is a carbocyclyl (e.g., aryl) or heterocyclyl (e.g., heteroaryl) group. In some embodiments, the bicyclic group can be substituted with 1, 2, 3, or 4 substituents as defined herein for cycloalkyl, heterocyclyl, and aryl groups.

The terms "carbocyclic" and "carbocyclyl," as used herein, refer to an optionally substituted $C_{3-12}$ monocyclic, bicyclic, or tricyclic structure in which the rings, which may be aromatic or non-aromatic, are formed by carbon atoms. Carbocyclic structures include cycloalkyl, cycloalkenyl, and aryl groups.

The term "carbamoyl," as used herein, represents —C(O)—$N(R^{N1})_2$, where the meaning of each $R^{N1}$ is found in the definition of "amino" provided herein.

The term "carbamoylalkyl," as used herein, represents an alkyl group, as defined herein, substituted by a carbamoyl group, as defined herein. The alkyl group can be further substituted with 1, 2, 3, or 4 substituent groups as described herein.

The term "carbamyl," as used herein, refers to a carbamate group having the structure —$NR^{N1}C(=O)OR$ or —OC(=O)$N(R^{N1})_2$, where the meaning of each $R^{N1}$ is found in the definition of "amino" provided herein, and R is alkyl, cycloalkyl, alkcycloalkyl, aryl, alkaryl, heterocyclyl (e.g., heteroaryl), or alkheterocyclyl (e.g., alkheteroaryl), as defined herein.

The term "carbonyl," as used herein, represents a C(O) group, which can also be represented as C=O.

The term "carboxyaldehyde" represents an acyl group having the structure —CHO.

The term "carboxy," as used herein, means —CO$_2$H.

The term "carboxyalkoxy," as used herein, represents an alkoxy group, as defined herein, substituted by a carboxy group, as defined herein. The alkoxy group can be further substituted with 1, 2, 3, or 4 substituent groups as described herein for the alkyl group.

The term "carboxyalkyl," as used herein, represents an alkyl group, as defined herein, substituted by a carboxy group, as defined herein. The alkyl group can be further substituted with 1, 2, 3, or 4 substituent groups as described herein.

The term "cyano," as used herein, represents an —CN group.

The term "cycloalkoxy" represents a chemical substituent of formula —OR, where R is a C$_{3-8}$ cycloalkyl group, as defined herein, unless otherwise specified. The cycloalkyl group can be further substituted with 1, 2, 3, or 4 substituent groups as described herein. Exemplary unsubstituted cycloalkoxy groups are from 3 to 8 carbons. In some embodiment, the cycloalkyl group can be further substituted with 1, 2, 3, or 4 substituent groups as described herein.

The term "cycloalkyl," as used herein represents a monovalent saturated or unsaturated non-aromatic cyclic hydrocarbon group from three to eight carbons, unless otherwise specified, and is exemplified by cyclopropyl, cyclobutyl, cyclopentyl, cyclohexyl, cycloheptyl, bicyclo[2.2.1]heptyl, and the like. When the cycloalkyl group includes one carbon-carbon double bond, the cycloalkyl group can be referred to as a "cycloalkenyl" group. Exemplary cycloalkenyl groups include cyclopentenyl, cyclohexenyl, and the like. The cycloalkyl groups of this invention can be optionally substituted with: (1) C$_{1-7}$ acyl (e.g., carboxyaldehyde); (2) C$_{1-20}$ alkyl (e.g., C$_{1-6}$ alkyl, C$_{1-6}$ alkoxy-C$_{1-6}$ alkyl, C$_{1-6}$ alkylsulfinyl-C$_{1-6}$ alkyl, amino-C$_{1-6}$ alkyl, azido-C$_{1-6}$ alkyl, (carboxyaldehyde)-C$_{1-6}$ alkyl, halo-C$_{1-6}$ alkyl (e.g., perfluoroalkyl), hydroxy-C$_{1-6}$ alkyl, nitro-C$_{1-6}$ alkyl, or C$_{1-6}$thioalkoxy-C$_{1-6}$ alkyl); (3) C$_{1-20}$ alkoxy (e.g., C$_{1-6}$ alkoxy, such as perfluoroalkoxy); (4) C$_{1-6}$ alkylsulfinyl; (5) C$_{6-10}$ aryl; (6) amino; (7) C$_{1-6}$ alk-C$_{6-10}$ aryl; (8) azido; (9) C$_{3-8}$ cycloalkyl; (10) C$_{1-6}$ alk-C$_{3-8}$ cycloalkyl; (11) halo; (12) C$_{1-12}$ heterocyclyl (e.g., C$_{1-12}$ heteroaryl); (13) (C$_{1-12}$ heterocyclyl)oxy; (14) hydroxy; (15) nitro; (16) C$_{1-20}$ thioalkoxy (e.g., C$_{1-6}$ thioalkoxy); (17) —(CH$_2$)$_q$CO$_2$R$^{A'}$, where q is an integer from zero to four, and R$^{A'}$ is selected from the group consisting of (a) C$_{1-6}$ alkyl, (b) C$_{6-10}$ aryl, (c) hydrogen, and (d) C$_{1-6}$ alk-C$_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) C$_{6-10}$ alkyl, (c) C$_{6-10}$ aryl, and (d) C$_{1-6}$ alk-C$_{6-10}$ aryl; (19) —(CH$_2$)$_q$SO$_2$R$^{D'}$, where q is an integer from zero to four and where R$^{D'}$ is selected from the group consisting of (a) C$_{6-10}$ alkyl, (b) C$_{6-10}$ aryl, and (c) C$_{1-6}$ alk-C$_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) C$_{6-10}$ alkyl, (c) C$_{6-10}$ aryl, and (d) C$_{1-6}$ alk-C$_{6-10}$ aryl; (21) thiol; (22) C$_{6-10}$ aryloxy; (23) C$_{3-8}$ cycloalkoxy; (24) C$_{6-10}$ aryl-C$_{1-6}$ alkoxy; (25) C$_{1-6}$ alk-C$_{1-12}$ heterocyclyl (e.g., C$_{1-6}$ alk-C$_{1-12}$ heteroaryl); (26) oxo; (27) C$_{2-20}$ alkenyl; and (28) C$_{2-20}$ alkynyl. In some embodiments, each of these groups can be further substituted as described herein. For example, the alkylene group of a C$_1$-alkaryl or a C$_1$-alkheterocyclyl can be further substituted with an oxo group to afford the respective aryloyl and (heterocyclyl)oyl substituent group.

The term "diastereomer," as used herein means stereoisomers that are not mirror images of one another and are non-superimposable on one another.

The term "effective amount" of an agent, as used herein, is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

The term "enantiomer," as used herein, means each individual optically active form of a compound of the invention, having an optical purity or enantiomeric excess (as determined by methods standard in the art) of at least 80% (i.e., at least 90% of one enantiomer and at most 10% of the other enantiomer), preferably at least 90% and more preferably at least 98%.

The term "halo," as used herein, represents a halogen selected from bromine, chlorine, iodine, or fluorine.

The term "haloalkoxy," as used herein, represents an alkoxy group, as defined herein, substituted by a halogen group (i.e., F, Cl, Br, or I). A haloalkoxy may be substituted with one, two, three, or, in the case of alkyl groups of two carbons or more, four halogens. Haloalkoxy groups include perfluoroalkoxys (e.g., —OCF$_3$), —OCHF$_2$, —OCH$_2$F, —OCCl$_3$, —OCH$_2$CH$_2$Br, —OCH$_2$CH(CH$_2$CH$_2$Br)CH$_3$, and —OCHICH$_3$. In some embodiments, the haloalkoxy group can be further substituted with 1, 2, 3, or 4 substituent groups as described herein for alkyl groups.

The term "haloalkyl," as used herein, represents an alkyl group, as defined herein, substituted by a halogen group (i.e., F, Cl, Br, or I). A haloalkyl may be substituted with one, two, three, or, in the case of alkyl groups of two carbons or more, four halogens. Haloalkyl groups include perfluoroalkyls (e.g., —CF$_3$), —CHF$_2$, —CH$_2$F, —CCl$_3$, —CH$_2$CH$_2$Br, —CH$_2$CH(CH$_2$CH$_2$Br)CH$_3$, and —CHICH$_3$. In some embodiments, the haloalkyl group can be further substituted with 1, 2, 3, or 4 substituent groups as described herein for alkyl groups.

The term "heteroalkylene," as used herein, refers to an alkylene group, as defined herein, in which one or two of the constituent carbon atoms have each been replaced by nitrogen, oxygen, or sulfur. In some embodiments, the heteroalkylene group can be further substituted with 1, 2, 3, or 4 substituent groups as described herein for alkylene groups.

The term "heteroaryl," as used herein, represents that subset of heterocyclyls, as defined herein, which are aromatic: i.e., they contain 4n+2 pi electrons within the mono- or multicyclic ring system. Exemplary unsubstituted heteroaryl groups are of 1 to 12 (e.g., 1 to 11, 1 to 10, 1 to 9, 2 to 12, 2 to 11, 2 to 10, or 2 to 9) carbons. In some embodiment, the heteroaryl is substituted with 1, 2, 3, or 4 substituents groups as defined for a heterocyclyl group.

The term "heterocyclyl," as used herein represents a 5-, 6- or 7-membered ring, unless otherwise specified, containing one, two, three, or four heteroatoms independently selected from the group consisting of nitrogen, oxygen, and sulfur. The 5-membered ring has zero to two double bonds, and the 6- and 7-membered rings have zero to three double bonds. Exemplary unsubstituted heterocyclyl groups are of 1 to 12 (e.g., 1 to 11, 1 to 10, 1 to 9, 2 to 12, 2 to 11, 2 to 10, or 2 to 9) carbons. The term "heterocyclyl" also represents a heterocyclic compound having a bridged multicyclic structure in which one or more carbons and/or heteroatoms bridges two non-adjacent members of a monocyclic ring, e.g., a quinuclidinyl group. The term "heterocyclyl" includes bicyclic, tricyclic, and tetracyclic groups in which any of the above heterocyclic rings is fused to one, two, or three carbocyclic rings, e.g., an aryl ring, a cyclohexane ring, a cyclohexene ring, a cyclopentane ring, a cyclopentene ring, or another monocyclic heterocyclic ring, such as indolyl, quinolyl, isoquinolyl, tetrahydroquinolyl, benzofuryl, benzothienyl and the like. Examples of fused heterocyclyls include tropanes and 1,2,3,5,8,8a-hexahydroindolizine. Heterocyclics include pyrrolyl, pyrrolinyl, pyrrolidinyl, pyrazolyl, pyrazolinyl, pyrazolidinyl, imidazolyl, imidazolinyl, imidazolidinyl, pyridyl, piperidinyl, homopiperidinyl, pyrazinyl, piperazinyl, pyrimidinyl, pyridazinyl, oxazolyl, oxazolidinyl, isoxazolyl, isoxazolidiniyl, morpholinyl, thiomorpholinyl, thiazolyl, thiazolidinyl, isothiazolyl, isothiazolidinyl, indolyl, indazolyl, quinolyl, isoquinolyl, quinoxalinyl, dihydroquinoxalinyl, quinazolinyl, cinnolinyl, phthalazinyl, benzimidazolyl, benzothiazolyl, benzoxazolyl, benzothiadiazolyl, furyl, thienyl, thiazolidinyl, isothiazolyl, triazolyl, tetrazolyl, oxadiazolyl (e.g., 1,2,3-oxadiazolyl), purinyl, thiadiazolyl (e.g., 1,2,3-thiadiazolyl), tetrahydrofuranyl, dihydrofuranyl, tetrahydrothienyl, dihydrothienyl, dihydroindolyl, dihydroquinolyl, tetrahydroquinolyl, tetrahydroisoquinolyl, dihydroisoquinolyl, pyranyl, dihydropyranyl, dithiazolyl, benzofuranyl, isobenzofuranyl, benzothienyl, and the like, including dihydro and tetrahydro forms thereof, where one or more double bonds are reduced and replaced with hydrogens. Still other exemplary heterocyclyls include: 2,3,4,5-tetrahydro-2-oxo-oxazolyl; 2,3-dihydro-2-oxo-1H-imidazolyl; 2,3,4,5-tetrahydro-5-oxo-1H-pyrazolyl (e.g., 2,3,4,5-tetrahydro-2-phenyl-5-oxo-1H-pyrazolyl); 2,3,4,5-tetrahydro-2,4-dioxo-1H-imidazolyl (e.g., 2,3,4,5-tetrahydro-2,4-dioxo-5-methyl-5-phenyl-1H-imidazolyl); 2,3-dihydro-2-thioxo-1,3,4-oxadiazolyl (e.g., 2,3-dihydro-2-thioxo-5-phenyl-1,3,4-oxadiazolyl); 4,5-dihydro-5-oxo-1H-triazolyl (e.g., 4,5-dihydro-3-methyl-4-amino 5-oxo-1H-triazolyl); 1,2,3,4-tetrahydro-2,4-dioxopyridinyl (e.g., 1,2,3,4-tetrahydro-2,4-dioxo-3,3-diethylpyridinyl); 2,6-dioxo-piperidinyl (e.g., 2,6-dioxo-3-ethyl-3-phenylpiperidinyl); 1,6-dihydro-6-oxopyridiminyl; 1,6-dihydro-4-oxopyrimidinyl (e.g., 2-(methylthio)-1,6-dihydro-4-oxo-5-methylpyrimidin-1-yl); 1,2,3,4-tetrahydro-2,4-dioxopyrimidinyl (e.g., 1,2,3,4-tetrahydro-2,4-dioxo-3-ethylpyrimidinyl); 1,6-dihydro-6-oxopyridazinyl (e.g., 1,6-dihydro-6-oxo-3-ethylpyridazinyl); 1,6-dihydro-6-oxo-1,2,4-triazinyl (e.g., 1,6-dihydro-5-isopropyl-6-oxo-1,2,4-triazinyl); 2,3-dihydro-2-oxo-1H-indolyl (e.g., 3,3-dimethyl-2,3-dihydro-2-oxo-1H-indolyl and 2,3-dihydro-2-oxo-3,3'-spiropropane-1H-indol-1-yl); 1,3-dihydro-1-oxo-2H-iso-indolyl; 1,3-dihydro-1,3-dioxo-2H-iso-indolyl; 1H-benzopyrazolyl (e.g., 1-(ethoxycarbonyl)-1H-benzopyrazolyl); 2,3-dihydro-2-oxo-1H-benzimidazolyl (e.g., 3-ethyl-2,3-dihydro-2-oxo-1H-benzimidazolyl); 2,3-dihydro-2-oxo-benzoxazolyl (e.g., 5-chloro-2,3-dihydro-2-oxo-benzoxazolyl); 2,3-dihydro-2-oxo-benzoxazolyl; 2-oxo-2H-benzopyranyl; 1,4-benzodioxanyl; 1,3-benzodioxanyl; 2,3-dihydro-3-oxo, 4H-1,3-benzothiazinyl; 3,4-dihydro-4-oxo-3H-quinazolinyl (e.g., 2-methyl-3,4-dihydro-4-oxo-3H-quinazolinyl); 1,2,3,4-tetrahydro-2,4-dioxo-3H-quinazolyl (e.g., 1-ethyl-1,2,3,4-tetrahydro-2,4-dioxo-3H-quinazolyl); 1,2,3,6-tetrahydro-2,6-dioxo-7H-purinyl (e.g., 1,2,3,6-tetrahydro-1,3-dimethyl-2,6-dioxo-7H-purinyl); 1,2,3,6-tetrahydro-2,6-dioxo-1H-purinyl (e.g., 1,2,3,6-tetrahydro-3,7-dimethyl-2,6-dioxo-1H-purinyl); 2-oxobenz[c,d]indolyl; 1,1-dioxo-2H-naphth[1,8-c,d]isothiazolyl; and 1,8-naphthylenedicarboxamido. Additional heterocyclics include 3,3a,4,5,6,6a-hexahydro-pyrrolo[3,4-b]pyrrol-(2H)-yl, and 2,5-diazabicyclo[2.2.1]heptan-2-yl, homopiperazinyl (or diazepanyl), tetrahydropyranyl, dithiazolyl, benzofuranyl, benzothienyl, oxepanyl, thiepanyl, azocanyl, oxecanyl, and thiocanyl. Heterocyclic groups also include groups of the formula

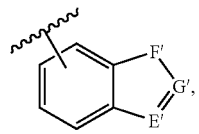

where

E' is selected from the group consisting of —N— and —CH—; F' is selected from the group consisting of —N=CH—, —NH—CH$_2$—, —NH—C(O)—, —NH—, —CH=N—, —CH$_2$—NH—, —C(O)—NH—, —CH=CH—, —CH$_2$—, —CH$_2$CH$_2$—, —CH$_2$O—, —OCH$_2$—, —O—, and —S—; and G' is selected from the group consisting of —CH— and —N—. Any of the heterocyclyl groups mentioned herein may be optionally substituted with one, two, three, four or five substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{2-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —(CH$_2$)$_q$CO$_2$R$^{A'}$, where q is an integer from zero to four, and R$^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —(CH$_2$)$_q$SO$_2$R$^{D'}$, where q is an integer from zero to four and where R$^{D'}$ is selected from the group consisting of (a) $C_{1-6}$ alkyl, (b) $C_{6-10}$ aryl, and (c) $C_{1-6}$ alk-$C_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) arylalkoxy; (25) $C_{1-6}$ alk-$C_{1-12}$ heterocyclyl (e.g., $C_{1-6}$ alk-$C_{1-12}$ heteroaryl); (26) oxo; (27) ($C_{1-12}$ heterocyclyl)imino; (28) $C_{2-20}$ alkenyl; and (29) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The term "(heterocyclyl)imino," as used herein, represents a heterocyclyl group, as defined herein, attached to the parent molecular group through an imino group. In some embodiments, the heterocyclyl group can be substituted with 1, 2, 3, or 4 substituent groups as defined herein.

The term "(heterocyclyl)oxy," as used herein, represents a heterocyclyl group, as defined herein, attached to the parent molecular group through an oxygen atom. In some embodiments, the heterocyclyl group can be substituted with 1, 2, 3, or 4 substituent groups as defined herein.

The term "(heterocyclyl)oyl," as used herein, represents a heterocyclyl group, as defined herein, attached to the parent molecular group through a carbonyl group. In some embodiments, the heterocyclyl group can be substituted with 1, 2, 3, or 4 substituent groups as defined herein.

The term "hydrocarbon," as used herein, represents a group consisting only of carbon and hydrogen atoms.

The term "hydroxy," as used herein, represents an —OH group.

The term "hydroxyalkenyl," as used herein, represents an alkenyl group, as defined herein, substituted by one to three hydroxy groups, with the proviso that no more than one hydroxy group may be attached to a single carbon atom of the alkyl group, and is exemplified by dihydroxypropenyl, hydroxyisopentenyl, and the like.

The term "hydroxyalkyl," as used herein, represents an alkyl group, as defined herein, substituted by one to three hydroxy groups, with the proviso that no more than one hydroxy group may be attached to a single carbon atom of the alkyl group, and is exemplified by hydroxymethyl, dihydroxypropyl, and the like.

The term "isomer," as used herein, means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

The term "N-protected amino," as used herein, refers to an amino group, as defined herein, to which is attached one or two N-protecting groups, as defined herein.

The term "N-protecting group," as used herein, represents those groups intended to protect an amino group against undesirable reactions during synthetic procedures. Commonly used N-protecting groups are disclosed in Greene, "Protective Groups in Organic Synthesis," 3$^{rd}$ Edition (John Wiley & Sons, New York, 1999), which is incorporated herein by reference. N-protecting groups include acyl, aryloyl, or carbamyl groups such as formyl, acetyl, propionyl, pivaloyl, t-butylacetyl, 2-chloroacetyl, 2-bromoacetyl, trifluoroacetyl, trichloroacetyl, phthalyl, o-nitrophenoxyacetyl, a-chlorobutyryl, benzoyl, 4-chlorobenzoyl, 4-bromobenzoyl, 4-nitrobenzoyl, and chiral auxiliaries such as protected or unprotected D, L or D, L-amino acids such as alanine, leucine, phenylalanine, and the like; sulfonyl-containing groups such as benzenesulfonyl, p-toluenesulfonyl, and the like; carbamate forming groups such as benzyloxycarbonyl, p-chlorobenzyloxycarbonyl, p-methoxybenzyloxycarbonyl, p-nitrobenzyloxycarbonyl, 2-nitrobenzyloxycarbonyl, p-bromobenzyloxycarbonyl, 3,4-dimethoxybenzyloxycarbonyl, 3,5-dimethoxybenzyloxycarbonyl, 2,4-dimethoxybenzyloxycarbonyl, 4-methoxybenzyloxycarbonyl, 2-nitro-4,5-dimethoxybenzyloxycarbonyl, 3,4,5-trimethoxybenzyloxycarbonyl, 1-(p-biphenylyl)-1-methylethoxycarbonyl, α,α-dimethyl-3,5-dimethoxybenzyloxycarbonyl, benzhydryloxy carbonyl, t-butyloxycarbonyl, diisopropylmethoxycarbonyl, isopropyloxycarbonyl, ethoxycarbonyl, methoxycarbonyl, allyloxycarbonyl, 2,2,2,-trichloroethoxycarbonyl, phenoxycarbonyl, 4-nitrophenoxy carbonyl, fluorenyl-9-methoxycarbonyl, cyclopentyloxycarbonyl, adamantyloxycarbonyl, cyclohexyloxycarbonyl, phenylthiocarbonyl, and the like, alkaryl groups such as benzyl, triphenylmethyl, benzyloxymethyl, and the like and silyl groups, such as trimethylsilyl, and the like. Preferred N-protecting groups are formyl, acetyl, benzoyl, pivaloyl, t-butylacetyl, alanyl, phenylsulfonyl, benzyl, t-butyloxycarbonyl (Boc), and benzyloxycarbonyl (Cbz).

The term "nitro," as used herein, represents an —NO$_2$ group.

The term "oxo" as used herein, represents =O.

The term "perfluoroalkyl," as used herein, represents an alkyl group, as defined herein, where each hydrogen radical bound to the alkyl group has been replaced by a fluoride radical. Perfluoroalkyl groups are exemplified by trifluoromethyl, pentafluoroethyl, and the like.

The term "perfluoroalkoxy," as used herein, represents an alkoxy group, as defined herein, where each hydrogen radical bound to the alkoxy group has been replaced by a fluoride radical. Perfluoroalkoxy groups are exemplified by trifluoromethoxy, pentafluoroethoxy, and the like.

The term "spirocyclyl," as used herein, represents a $C_{2-7}$ alkylene diradical, both ends of which are bonded to the same carbon atom of the parent group to form a spirocyclic group, and also a $C_{1-6}$ heteroalkylene diradical, both ends of which are bonded to the same atom. The heteroalkylene radical forming the spirocyclyl group can containing one, two, three, or four heteroatoms independently selected from the group consisting of nitrogen, oxygen, and sulfur. In some embodiments, the spirocyclyl group includes one to seven carbons, excluding the carbon atom to which the diradical is attached. The spirocyclyl groups of the invention may be optionally substituted with 1, 2, 3, or 4 substituents provided herein as optional substituents for cycloalkyl and/or heterocyclyl groups.

The term "stereoisomer," as used herein, refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present invention may exist in different tautomeric forms, all of the latter being included within the scope of the present invention.

The term "sulfoalkyl," as used herein, represents an alkyl group, as defined herein, substituted by a sulfo group of —SO$_3$H. In some embodiments, the alkyl group can be further substituted with 1, 2, 3, or 4 substituent groups as described herein.

The term "sulfonyl," as used herein, represents an —S(O)$_2$— group.

The term "thioalkaryl," as used herein, represents a chemical substituent of formula —SR, where R is an alkaryl group. In some embodiments, the alkaryl group can be further substituted with 1, 2, 3, or 4 substituent groups as described herein.

The term "thioalkheterocyclyl," as used herein, represents a chemical substituent of formula —SR, where R is an alkheterocyclyl group. In some embodiments, the alkheterocyclyl group can be further substituted with 1, 2, 3, or 4 substituent groups as described herein.

The term "thioalkoxy," as used herein, represents a chemical substituent of formula —SR, where R is an alkyl group, as defined herein. In some embodiments, the alkyl group can be further substituted with 1, 2, 3, or 4 substituent groups as described herein.

The term "thiol" represents an —SH group.

Compound: As used herein, the term "compound," is meant to include all stereoisomers, geometric isomers, tautomers, and isotopes of the structures depicted.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C=N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond and the concomitant migration of a proton. Tautomeric forms include prototropic tautomers which are isomeric protonation states having the same empirical formula and total charge. Examples prototropic tautomers include ketone-enol pairs, amide-imidic acid pairs, lactam-lactim pairs, amide-imidic acid pairs, enamine-imine pairs, and annular forms where a proton can occupy two or more positions of a heterocyclic system, such as, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Condition: As used herein, the term "condition" refers to a disorder that presents with observable symptoms.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an oligonucleotide or polypeptide or may apply to a portion, region or feature thereof.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present invention may be single units or multimers or comprise one or more components of a complex or higher order structure.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of an oncology-related polynucleotide, oncology-related primary construct or oncology-related mmRNA to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Disease: As used herein, the term "disease" refers to an abnormal condition affecting the body of an organism often showing specific bodily symptoms.

Disorder: As used herein, the term "disorder," refers to a disruption of or an interference with normal functions or established systems of the body.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Dose splitting factor (DSF)-ratio of PUD of dose split treatment divided by PUD of total daily dose or single unit dose. The value is derived from comparison of dosing regimens groups.

Encoded protein cleavage signal: As used herein, "encoded protein cleavage signal" refers to the nucleotide sequence which encodes a protein cleavage signal.

Engineered: As used herein, embodiments of the invention are "engineered" when they are designed to have a feature or property, whether structural or chemical, that varies from a starting point, wild type or native molecule.

Exosome: As used herein, "exosome" is a vesicle secreted by mammalian cells or a complex involved in RNA degradation.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least an oncology-related polynucleotide, oncology-related primary construct or oncology-related mmRNA and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Genotype: As used herein, "genotype" refers to the change in the genotype, or genetic makeup, of a subject, cell, tissue, organ and/or organism.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

Linker: As used herein, a linker refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form mmRNA multimers (e.g., through linkage of two or more oncology-related polynucleotides, oncology-related primary constructs, or oncology-related mmRNA molecules) or mmRNA conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Metastasis: As used herein, the term "metastasis" means the process by which cancer spreads from the place at which it first arose as a primary tumor to distant locations in the body.

Method of Treating: The phrase "a method of treating" or its equivalent, when applied to, for example, cancer refers to a procedure or course of action that is designed to reduce or eliminate the number of cancer cells, prevent the increase in the number of cancer cells, or to alleviate the symptoms of a cancer in a subject. A method of treating cancer or another oncology-related disorder does not necessarily mean that the cancer cells or other disorder will, in fact, be completely eliminated, that the number of cells or disorder will, in fact, be reduced, or that the symptoms of a cancer or other disorder will, in fact, be alleviated. Often, a method of treating cancer will be performed even with a low likelihood of success, but which, given the medical history and estimated survival expectancy of a subject, is nevertheless deemed an overall beneficial course of action.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally. In one embodiment, the mRNA molecules of the present invention are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Naturally occurring: As used herein, "naturally occurring" means existing in nature without artificial aid.

Non-human vertebrate: As used herein, a "non human vertebrate" includes all vertebrates except Homo sapiens, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene, or cellular transcript.

Oncology-related: As used herein, the term "oncology-related" refers to any disease, disorder, condition, treatment, process, substance or compound related to any aspect of one or more hyperproliferative diseases, disorders and/or conditions including, but not limited to, cancer.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Paratope: As used herein, a "paratope" refers to the antigen-binding site of an antibody.

Patient: As used herein, "patient" refers to a subject who may seek or be in need of treatment, requires treatment, is receiving treatment, will receive treatment, or a subject who is under care by a trained professional for a particular disease or condition.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

Peptide: As used herein, "peptide" is less than or equal to 50 amino acids long, e.g., about 5, 10, 15, 20, 25, 30, 35, 40, 45, or 50 amino acids long.

Pharmaceutical composition: The phrase "pharmaceutical composition" refers to a composition that alters the etiology of a disease, disorder and/or condition.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, $17^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Phenotype: As used herein, "phenotype" refers to the set of observable characteristics of a subject, cell, tissue, organ and/or organism.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc divided by the measure in the body fluid.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestered in some way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Pro-drugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Progression: As used herein, the term "progression" (e.g., cancer progression) means the advancement or worsening of or toward a disease or condition.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3\psi$), and 2'-O-methyl-pseudouridine ($\psi m$).

Purified: As used herein, "purify," "purified," "purification" means to make substantially pure or clear from unwanted components, material defilement, admixture or imperfection.

Regression: As used herein, the term "regression" or "degree of regression" refers to the reversal, either phenotypically or genotypically, of a cancer progression. Slowing or stopping cancer progression may be considered regression.

Reducing the effect: As used herein, the phrase "reducing the effect" when referring to symptoms, means reducing, eliminating or alleviating the symptom in the subject. It does not necessarily mean that the symptom will, in fact, be completely eliminated, reduced or alleviated.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Side effect: As used herein, the phrase "side effect" refers to a secondary effect of treatment.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Skin: The term "skin" is the thin layer of tissue forming the natural outer covering of the body of a subject and includes the epidermis and the dermis. The dermis is the thick layer of living tissue below the epidermis which is the surface epithelium of the skin.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Symptom: As used herein, the term "symptom" is a signal of a disease, disorder and/or condition. For example, symptoms may be felt or noticed by the subject who has them but may not be easily accessed by looking at a subject's outward appearance or behaviors. Examples of symptoms include, but are not limited to, weakness, aches and pains, fever, fatigue, weight loss, blood clots, increased blood calcium levels, low white blood cell count, short of breath, dizziness, headaches, hyperpigmentation, jaundice, erthema, pruritis, excessive hair growth, change in bowel habits, change in bladder function, long-lasting sores, white patches inside the mouth, white spots on the tongue, unusual bleeding or discharge, thickening or lump on parts of the body, indigestion, trouble swallowing, changes in warts or moles, change in new skin and nagging cough or hoarseness.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Tumor: As used herein, a "tumor" is an abnormal growth of tissue, whether benign or malignant.

Tumor growth: As used herein, the term "tumor growth" or "tumor metastases" means an increased mass or volume of the tumor or expansion of the tumor distribution.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1

Modified mRNA Production

Modified mRNAs (mmRNA) according to the invention may be made using standard laboratory methods and materials. The open reading frame (ORF) of the gene of interest may be flanked by a 5' untranslated region (UTR) which may contain a strong Kozak translational initiation signal and/or an alpha-globin 3' UTR which may include an oligo(dT) sequence for templated addition of a poly-A tail. The modified mRNAs may be modified to reduce the cellular innate immune response. The modifications to reduce the cellular response may include pseudouridine (ψ) and 5-methyl-cytidine (5meC, 5mc or m$^5$C). (See, Kariko K et al. Immunity 23:165-75 (2005), Kariko K et al. Mol Ther 16:1833-40 (2008), Anderson B R et al. NAR (2010); each of which are herein incorporated by reference in their entireties).

The ORF may also include various upstream or downstream additions (such as, but not limited to, β-globin, tags, etc.) may be ordered from an optimization service such as, but limited to, DNA2.0 (Menlo Park, Calif.) and may contain multiple cloning sites which may have XbaI recognition. Upon receipt of the construct, it may be reconstituted and transformed into chemically competent E. coli.

The methods described herein to make modified mRNA may be used to produce molecules of all sizes including long molecules. Modified mRNA using the described methods has been made for different sized molecules including glucosidase, alpha; acid (GAA) (3.2 kb), cystic fibrosis transmembrane conductance regulator (CFTR) (4.7 kb), Factor VII (7.3 kb), lysosomal acid lipase (45.4 kDa), glucocerebrosidase (59.7 kDa) and iduronate 2-sulfatase (76 kDa).

For the present invention, NEB DH5-alpha Competent E. coli are used. Transformations are performed according to NEB instructions using 100 ng of plasmid. The protocol is as follows:
1. Thaw a tube of NEB 5-alpha Competent E. coli cells on ice for 10 minutes.
2. Add 1-5 μl containing 1 pg-100 ng of plasmid DNA to the cell mixture. Carefully flick the tube 4-5 times to mix cells and DNA. Do not vortex.
3. Place the mixture on ice for 30 minutes. Do not mix.
4. Heat shock at 42° C. for exactly 30 seconds. Do not mix.
5. Place on ice for 5 minutes. Do not mix.
6. Pipette 950 μl of room temperature SOC into the mixture.
7. Place at 37° C. for 60 minutes. Shake vigorously (250 rpm) or rotate.
8. Warm selection plates to 37° C.
9. Mix the cells thoroughly by flicking the tube and inverting.

Spread 50-100 μl of each dilution onto a selection plate and incubate overnight at 37° C. Alternatively, incubate at 30° C. for 24-36 hours or 25° C. for 48 hours.

A single colony is then used to inoculate 5 ml of LB growth media using the appropriate antibiotic and then allowed to grow (250 RPM, 37° C.) for 5 hours. This is then used to inoculate a 200 ml culture medium and allowed to grow overnight under the same conditions.

To isolate the plasmid (up to 850 μg), a maxi prep is performed using the Invitrogen PURELINK™ HiPure Maxiprep Kit (Carlsbad, Calif.), following the manufacturer's instructions.

Figure 3:
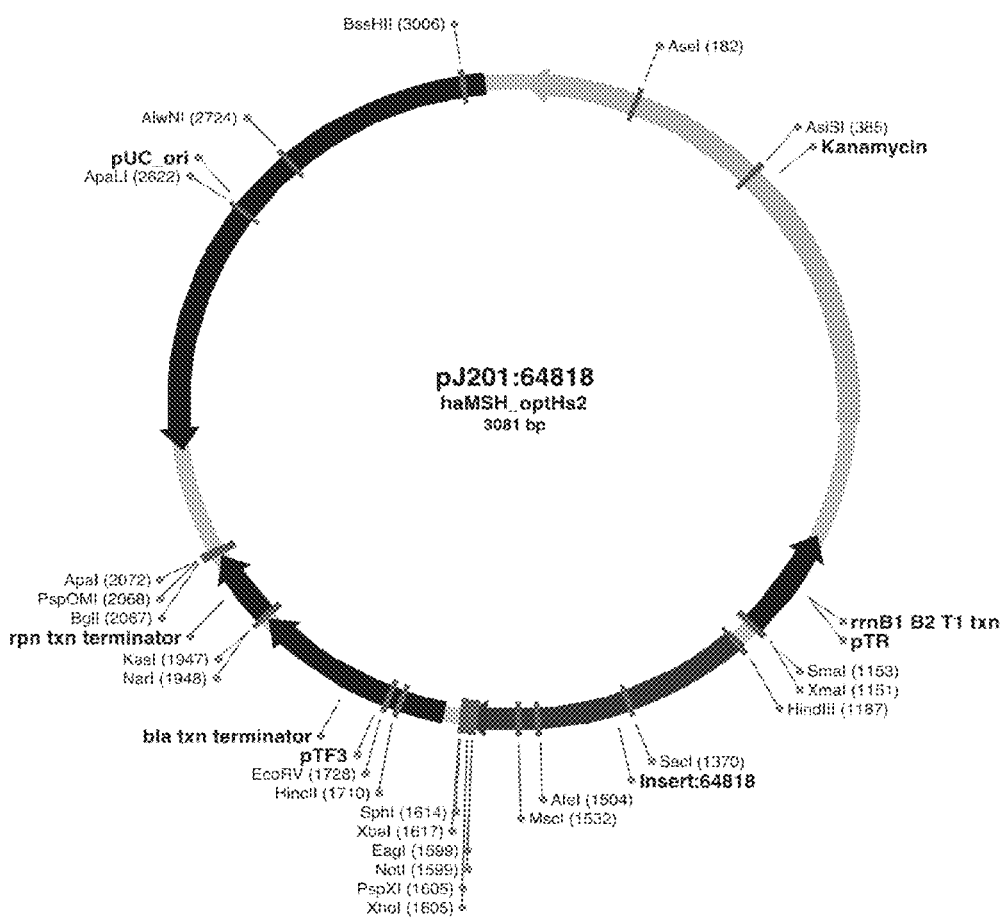
FIG. 3 is a representative plasmid useful in the IVT reactions taught herein. The plasmid contains Insert 64818, designed by the instant inventors.

In order to generate cDNA for In Vitro Transcription (IVT), the plasmid (an Example of which is shown in FIG. 3) is first linearized using a restriction enzyme such as XbaI. A typical restriction digest with XbaI will comprise the following: Plasmid 1.0 μg; 10× Buffer 1.0 μl; XbaI 1.5 μl; dH$_2$0 up to 10 μl; incubated at 37° C. for 1 hr. If performing at lab scale (<5 μg), the reaction is cleaned up using Invitrogen's PURELINK™ PCR Micro Kit (Carlsbad, Calif.) per manufacturer's instructions. Larger scale purifications may need to be done with a product that has a larger load capacity such as Invitrogen's standard PURELINK™ PCR Kit (Carlsbad, Calif.). Following the cleanup, the linearized vector is quantified using the NanoDrop and analyzed to confirm linearization using agarose gel electrophoresis.

As a non-limiting example, G-CSF may represent the polypeptide of interest. Sequences used in the steps outlined in Examples 1-5 are shown in Table 12. It should be noted that the start codon (ATG) has been underlined in each sequence of Table 12.

TABLE 12

G-CSF Sequences

| SEQ ID NO | Description |
|---|---|
| 33894 | cDNAsequence:<br>ATGGCTGGACCTGCCACCCAGAGCCCCATGAAGCTGATGGCCC<br>TGCAGCTGCTGCTGTGGCACAGTGCACTCTGGACAGTGCAGGA<br>AGCCACCCCCTGGGCCCTGCCAGCTCCCTGCCCCAGAGCTTC<br>CTGCTCAAGTGCTTAGAGCAAGTGAGGAAGATCCAGGGCGATG<br>GCGCAGCGCTCCAGGAGAAGCTGTGTGCCACCTACAAGCTGTG<br>CCACCCCGAGGAGCTGGTGCTGCTCGGACACTCTCTGGGCATC<br>CCCTGGGCTCCCCTGAGCAGCTGCCCCAGCCAGGCCCTGCAGC<br>TGGCAGGCTGCTTGAGCCAACTCCATAGCGGCCTTTTCCTCTA<br>CCAGGGGCTCCTGCAGGCCCTGGAAGGGATCTCCCCCGAGTTG<br>GGTCCCACCTTGGACACACTGCAGCTGGACGTCGCCGACTTTG<br>CCACCACCATCTGGCAGCAGATGGAAGAACTGGGAATGGCCCC<br>TGCCCTGCAGCCCACCCAGGGTGCCATGCCGGCCTTCGCCTCT<br>GCTTTCCAGCGCCGGGCAGGAGGGGTCCTGGTTGCCTCCCATC<br>TGCAGAGCTTCCTGGAGGTGTCGTACCGCGTTCTACGCCACCT<br>TGCCCAGCCCTGA |
| 33895 | cDNA having T7 polymerase site, AfeI and Xba restriction site:<br>TAATACGACTCACTATA<br>GGGAAATAAGAGAGAAAAGAAGAGTAAGAAGAAATATAAGAGC<br>CACCATGGCTGGACCTGCCACCCAGAGCCCCATGAAGCTGATG<br>GCCCTGCAGCTGCTGCTGTGGCACAGTGCACTCTGGACAGTGC<br>AGGAAGCCACCCCCTGGGCCCTGCCAGCTCCCTGCCCCAGAG<br>CTTCCTGCTCAAGTGCTTAGAGCAAGTGAGGAAGATCCAGGGC<br>GATGGCGCAGCGCTCCAGGAGAAGCTGTGTGCCACCTACAAGC<br>TGTGCCACCCCGAGGAGCTGGTGCTGCTCGGACACTCTCTGGG<br>CATCCCCTGGGCTCCCCTGAGCAGCTGCCCCAGCCAGGCCCTG<br>CAGCTGGCAGGCTGCTTGAGCCAACTCCATAGCGGCCTTTTCC<br>TCTACCAGGGGCTCCTGCAGGCCCTGGAAGGGATCTCCCCCGA<br>GTTGGGTCCCACCTTGGACACACTGCAGCTGGACGTCGCCGAC<br>TTTGCCACCACCATCTGGCAGCAGATGGAAGAACTGGGAATGG<br>CCCCTGCCCTGCAGCCCACCCAGGGTGCCATGCCGGCCTTCGC<br>CTCTGCTTTCCAGCGCCGGGCAGGAGGGGTCCTGGTTGCCTCC<br>CATCTGCAGAGCTTCCTGGAGGTGTCGTACCGCGTTCTACGCC<br>ACCTTGCCCAGCCCTGAAGCGCTGCCTTCTGCGGGGCTTGCCT<br>TCTGGCCATGCCCTTCTTCTCTCCCTTGCACCTGTACCTCTTG<br>GTCTTTGAATAAAGCCTGAGTAGGAAGGCGGCCGCTCGAGCAT<br>GCATCTAGA |
| 33896 | Optimized sequence; containing T7 polymerase site, AfeI and Xba restriction site<br>TAATACGACTCACTATA<br>GGGAAATAAGAGAGAAAAGAAGAGTAAGAAGAAATATAAGAGC<br>CACCATGGCCGGTCCCGCGACCCAAAGCCCCATGAAACTTATG<br>GCCCTGCAGTTGCTGCTTTGGCACTCGGCCCTCTGGACAGTCC<br>AAGAAGCGACTCCTCTCGGACCTGCCTCATCGTTGCCGCAGTC<br>ATTCCTTTTGAAGTGTCTGGAGCAGGTGCGAAAGATTCAGGGC<br>GATGGAGCCGCACTCCAAGAGAAGCTCTGCGCGACATACAAAC<br>TTTGCCATCCCGAGGAGCTCGTACTGCTCGGGCACAGCTTGGG<br>GATTCCCTGGGCTCCTCTCTCGTCCTGTCCGTCGCAGGCTTTG<br>CAGTTGGCAGGGTGCCTTTCCCAGCTCCACTCCGGTTTGTTCT<br>TGTATCAGGGACTGCTGCAAGCCCTTGAGGGAATCTCGCCAGA<br>ATTGGGCCCGACGCTGGACACGTTGCAGCTCGACGTGGCGGAT<br>TTCGCAACAACCATCTGGCAGCAGATGGAGGAACTGGGGATGG<br>CACCCGCGCTGCAGCCCACGCAGGGGGCAATGCCGGCCTTTGC<br>GTCCGCGTTTCAGCGCAGGGCGGGTGGAGTCCTCGTAGCGAGC<br>CACCTTCAATCATTTTTGGAAGTCTCGTACCGGGTGCTGAGAC<br>ATCTTGCGCAGCCGTGAAGCGCTGCCTTCTGCGGGGCTTGCCT<br>TCTGGCCATGCCCTTCTTCTCTCCCTTGCACCTGTACCTCTTG<br>GTCTTTGAATAAAGCCTGAGTAGGAAGGCGGCCGCTCGAGCAT<br>GCATCTAGA |
| 33897 | mRNA sequence (transcribed)<br>GGGAAAUAAGAGAGAAAAGAAGAGUAAGAAGAAAUAUAAGAGC<br>CACCAUGGCCGGUCCCGCGACCCAAAGCCCCAUGAAACUUAUG<br>GCCCUGCAGUUGCUGCUUUGGCACUCGGCCCUCUGGACAGUCC<br>AAGAAGCGACUCCUCUCGGACCUGCCUCAUCGUUGCCGCAGUC<br>AUUCCUUUUGAAGUGUCUGGAGCAGGUGCGAAAGAUUCAGGGC |

TABLE 12 -continued

G-CSF Sequences

| SEQ ID NO | Description |
|---|---|
| | GAUGGAGCCGCACUCCAAGAGAAGCUCUGCGCGACAUACAAAC<br>UUUGCCAUCCCGAGGAGCUCGUACUGCUCGGGCACAGCUUGGG<br>CGAUUCCUGGGCUCCUCUCUCGUCCUGUCCGUCGCAGGCUUUG<br>CAGUUGGCAGGGUGCCUUUCCCAGCUCCACUCCGGUUUGUUCU<br>UGUAUCAGGGACUGCUGCAAGCCCUUGAGGGAAUCUCGCCAGA<br>AUUGGGCCCGACGCUGGACACGUUGCAGCUCGACGUGGCGGAU<br>UUCGCAACAACCAUCUGGCAGCAGAUGGAGGAACUGGGGAUGG<br>CACCCGCGCUGCAGCCCACGCAGGGGGCAAUGCCGGCCUUUGC<br>GUCCGCGUUUCAGCGCAGGGCGGGUGGAGUCCUCGUAGCGAGC<br>CACCUUCAAUCAUUUUUGGAAGUCUCGUACCGGGUGCUGAGAC<br>AUCUUGCGCAGCCGUGAAGCGCUGCCUUCUGCGGGGCUUGCCU<br>UCUGGCCAUGCCCUUCUUCUCUCCCUUGCACCUGUACCUCUUG<br>GUCUUUGAAUAAAGCCUGAGUAGGAAG |

Example 2

PCR for cDNA Production

PCR procedures for the preparation of cDNA are performed using 2×KAPA HIFI™ HotStart ReadyMix by Kapa Biosystems (Woburn, Mass.). This system includes 2×KAPA ReadyMix 12.5 µl; Forward Primer (10 uM) 0.75 µl; Reverse Primer (10 uM) 0.75 µl; Template cDNA 100 ng; and dH$_2$0 diluted to 25.0 µl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant invention incorporates a poly-T$_{120}$ for a poly-A$_{120}$ in the mRNA. Other reverse primers with longer or shorter poly(T) tracts can be used to adjust the length of the poly(A) tail in the mRNA.

The reaction is cleaned up using Invitrogen's PURELINK™ PCR Micro Kit (Carlsbad, Calif.) per manufacturer's instructions (up to 5 µg). Larger reactions will require a cleanup using a product with a larger capacity. Following the cleanup, the cDNA is quantified using the NANODROP™ and analyzed by agarose gel electrophoresis to confirm the cDNA is the expected size. The cDNA is then submitted for sequencing analysis before proceeding to the in vitro transcription reaction.

Example 3

In Vitro Transcription (IVT)

The in vitro transcription reaction generates mRNA containing modified nucleotides or modified RNA. The input nucleotide triphosphate (NTP) mix is made in-house using natural and un-natural NTPs.

A typical in vitro transcription reaction includes the following:

| | | |
|---|---|---|
| 1. | Template cDNA | 1.0 µg |
| 2. | 10× transcription buffer (400 mM Tris-HCl pH 8.0, 190 mM MgCl$_2$, 50 mM DDT, 10 mM Spermidine) | 2.0 µl |
| 3. | Custom NTPs (25 mM each) | 7.2 µl |
| 4. | RNase Inhibitor | 20 U |
| 5. | T7 RNA polymerase | 3000 U |
| 6. | dH$_2$O | Up to 20.0 µl. and |
| 7. | Incubation at 37° C. for 3 hr-5 hrs. | |

The crude IVT mix may be stored at 4° C. overnight for cleanup the next day. 1 U of RNase-free DNase is then used to digest the original template. After 15 minutes of incubation at 37° C., the mRNA is purified using Ambion's MEGA-CLEAR™ Kit (Austin, Tex.) following the manufacturer's instructions. This kit can purify up to 500 µg of RNA. Following the cleanup, the RNA is quantified using the Nano-Drop and analyzed by agarose gel electrophoresis to confirm the RNA is the proper size and that no degradation of the RNA has occurred.

Example 4

Enzymatic Capping of mRNA

Capping of the mRNA is performed as follows where the mixture includes: IVT RNA 60 µg-180 µg and $dH_2O$ up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM $MgCl_2$) (10.0 µl); 20 mM GTP (5.0 µl); 20 mM S-Adenosyl Methionine (2.5 µl); RNase Inhibitor (100 U); 2'-O-Methyltransferase (400U); Vaccinia capping enzyme (Guanylyl transferase) (40 U); $dH_2O$ (Up to 28 µl); and incubation at 37° C. for 30 minutes for 60 µg RNA or up to 2 hours for 180 µg of RNA.

The mRNA is then purified using Ambion's MEGA-CLEAR™ Kit (Austin, Tex.) following the manufacturer's instructions. Following the cleanup, the RNA is quantified using the NANODROP™ (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 5

PolyA Tailing Reaction

Without a poly-T in the cDNA, a poly-A tailing reaction must be performed before cleaning the final product. This is done by mixing Capped IVT RNA (100 µl); RNase Inhibitor (20 U); 10× Tailing Buffer (0.5 M Tris-HCl (pH 8.0), 2.5 M NaCl, 100 mM $MgCl_2$) (12.0 µl); 20 mM ATP (6.0 µl); Poly-A Polymerase (20 U); $dH_2O$ up to 123.5 µl and incubation at 37° C. for 30 min. If the poly-A tail is already in the transcript, then the tailing reaction may be skipped and proceed directly to cleanup with Ambion's MEGACLEAR™ kit (Austin, Tex.) (up to 500 µg). Poly-A Polymerase is preferably a recombinant enzyme expressed in yeast.

For studies performed and described herein, the poly-A tail is encoded in the IVT template to comprise 160 nucleotides in length. However, it should be understood that the processivity or integrity of the polyA tailing reaction may not always result in exactly 160 nucleotides. Hence polyA tails of approximately 160 nucleotides, e.g, about 150-165, 155, 156, 157, 158, 159, 160, 161, 162, 163, 164 or 165 are within the scope of the invention.

Example 6

Natural 5' Caps and 5' Cap Analogues

5'-capping of modified RNA may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5)ppp(5')A; G(5')ppp(5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 7

Capping

A. Protein Expression Assay

Synthetic mRNAs encoding human G-CSF (cDNA shown in SEQ ID NO: 33894; mRNA sequence fully modified with 5-methylcytosine at each cytosine and pseudouridine replacement at each uridine site shown in SEQ ID NO: 33897 with a polyA tail approximately 160 nucleotides in length not shown in sequence) containing the ARCA (3' O-Me-m7G(5') ppp(5')G) cap analog or the Cap1 structure can be transfected into human primary keratinocytes at equal concentrations. 6, 12, 24 and 36 hours post-transfection the amount of G-CSF secreted into the culture medium can be assayed by ELISA. Synthetic mRNAs that secrete higher levels of G-CSF into the medium would correspond to a synthetic mRNA with a higher translationally-competent Cap structure.

B. Purity Analysis Synthesis

Synthetic mRNAs encoding human G-CSF (cDNA shown in SEQ ID NO: 33894; mRNA sequence fully modified with 5-methylcytosine at each cytosine and pseudouridine replacement at each uridine site shown in SEQ ID NO: 33897 with a polyA tail approximately 160 nucleotides in length not shown in sequence) containing the ARCA cap analog or the Cap1 structure crude synthesis products can be compared for purity using denaturing Agarose-Urea gel electrophoresis or HPLC analysis. Synthetic mRNAs with a single, consolidated band by electrophoresis correspond to the higher purity product compared to a synthetic mRNA with multiple bands or streaking bands. Synthetic mRNAs with a single HPLC peak would also correspond to a higher purity product. The capping reaction with a higher efficiency would provide a more pure mRNA population.

C. Cytokine Analysis

Synthetic mRNAs encoding human G-CSF (cDNA shown in SEQ ID NO: 33894; mRNA sequence fully modified with 5-methylcytosine at each cytosine and pseudouridine replacement at each uridine site shown in SEQ ID NO: 33897 with a polyA tail approximately 160 nucleotides in length not shown in sequence) containing the ARCA cap analog or the Cap1 structure can be transfected into human primary keratinocytes at multiple concentrations. 6, 12, 24 and 36 hours post-transfection the amount of pro-inflammatory cytokines such as TNF-alpha and IFN-beta secreted into the culture medium can be assayed by ELISA. Synthetic mRNAs that secrete higher levels of pro-inflammatory cytokines into the medium would correspond to a synthetic mRNA containing an immune-activating cap structure.

D. Capping Reaction Efficiency

Synthetic mRNAs encoding human G-CSF (cDNA shown in SEQ ID NO: 33894; mRNA sequence fully modified with 5-methylcytosine at each cytosine and pseudouridine replacement at each uridine site shown in SEQ ID NO: 33897 with a polyA tail approximately 160 nucleotides in length not shown in sequence) containing the ARCA cap analog or the Cap1 structure can be analyzed for capping reaction efficiency by LC-MS after capped mRNA nuclease treatment. Nuclease treatment of capped mRNAs would yield a mixture of free nucleotides and the capped 5'-5-triphosphate cap structure detectable by LC-MS. The amount of capped product on the LC-MS spectra can be expressed as a percent of total mRNA from the reaction and would correspond to capping reaction efficiency. The cap structure with higher capping reaction efficiency would have a higher amount of capped product by LC-MS.

Example 8

Agarose Gel Electrophoresis of Modified RNA or RT PCR Products

Individual modified RNAs (200-400 ng in a 20 µl volume) or reverse transcribed PCR products (200-400 ng) are loaded into a well on a non-denaturing 1.2% Agarose E-Gel (Invitrogen, Carlsbad, Calif.) and run for 12-15 minutes according to the manufacturer protocol.

Example 9

Nanodrop Modified RNA Quantification and UV Spectral Data

Modified RNAs in TE buffer (1 µl) are used for Nanodrop UV absorbance readings to quantitate the yield of each modified RNA from an in vitro transcription reaction.

Example 10

Formulation of Modified mRNA Using Lipidoids

Modified mRNAs (mmRNA) are formulated for in vitro experiments by mixing the mmRNA with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations was used as a starting point. Initial mmRNA-lipidoid formulations may consist of particles composed of 42% lipidoid, 48% cholesterol and 10% PEG, with further optimization of ratios possible. After formation of the particle, mmRNA is added and allowed to integrate with the complex. The encapsulation efficiency is determined using a standard dye exclusion assays.

Materials and Methods for Examples 11-15

A. Lipid Synthesis

Six lipids, DLin-DMA, DLin-K-DMA, DLin-KC2-DMA, 98N12-5, C12-200 and DLin-MC3-DMA, were synthesized by methods outlined in the art in order to be formulated with modified RNA. DLin-DMA and precursors were synthesized as described in Heyes et. al, J. Control Release, 2005, 107, 276-287. DLin-K-DMA and DLin-KC2-DMA and precursors were synthesized as described in Semple et. al, Nature Biotechnology, 2010, 28, 172-176. 98N12-5 and precursor were synthesized as described in Akinc et. al, Nature Biotechnology, 2008, 26, 561-569.

C, 12-200 and precursors were synthesized according to the method outlined in Love et. al, PNAS, 2010, 107, 1864-1869. 2-epoxydodecane (5.10 g, 27.7 mmol, 8.2 eq) was added to a vial containing Amine 200 (0.723 g, 3.36 mmol, 1 eq) and a stirring bar. The vial was sealed and warmed to 80° C. The reaction was stirred for 4 days at 80° C. Then the mixture was purified by silica gel chromatography using a gradient from pure dichloromethane (DCM) to DCM:MeOH 98:2. The target compound was further purified by RP-HPLC to afford the desired compound.

DLin-MC3-DMA and precursors were synthesized according to procedures described in WO 2010054401 herein incorporated by reference in its entirety. A mixture of dilinoleyl methanol (1.5 g, 2.8 mmol, 1 eq), N,N-dimethylaminobutyric acid (1.5 g, 2.8 mmol, 1 eq), DIPEA (0.73 mL, 4.2 mmol, 1.5 eq) and TBTU(1.35 g, 4.2 mmol, 1.5 eq) in 10 mL of DMF was stirred for 10 h at room temperature. Then the reaction mixture was diluted in ether and washed with water. The organic layer was dried over anhydrous sodium sulfate, filtrated and concentrated under reduced pressure. The crude product was purified by silica gel chromatography using a gradient DCM to DCM:MeOH 98:2. Subsequently the target compound was subjected to an additional RP-HPLC purification which was done using a YMC-Pack C4 column to afford the target compound.

B. Formulation of Modified RNA Nanoparticles

Solutions of synthesized lipid, 1,2-distearoyl-3-phosphatidylcholine (DSPC) (Avanti Polar Lipids, Alabaster, Ala.), cholesterol (Sigma-Aldrich, Taufkirchen, Germany), and α-[3'-(1,2-dimyristoyl-3-propanoxy)-carboxamide-propyl]-ω-methoxy-polyoxyethylene (PEG-c-DOMG) (NOF, Bouwelven, Belgium) were prepared at concentrations of 50 mM in ethanol and stored at −20° C. The lipids were combined to yield molar ratio of 50:10:38.5:1.5 (Lipid: DSPC: Cholesterol: PEG-c-DOMG) and diluted with ethanol to a final lipid concentration of 25 mM. Solutions of modified mRNA at a concentration of 1-2 mg/mL in water were diluted in 50 mM sodium citrate buffer at a pH of 3 to form a stock modified mRNA solution. Formulations of the lipid and modified mRNA were prepared by combining the synthesized lipid solution with the modified mRNA solution at total lipid to modified mRNA weight ratio of 10:1, 15:1, 20:1 and 30:1. The lipid ethanolic solution was rapidly injected into aqueous modified mRNA solution to afford a suspension containing 33% ethanol. The solutions were injected either manually (MI) or by the aid of a syringe pump (SP) (Harvard Pump 33 Dual Syringe Pump Harvard Apparatus Holliston, Mass.).

To remove the ethanol and to achieve the buffer exchange, the formulations were dialyzed twice against phosphate buffered saline (PBS), pH 7.4 at volumes 200-times of the primary product using a Slide-A-Lyzer cassettes (Thermo Fisher Scientific Inc. Rockford, Ill.) with a molecular weight cutoff (MWCO) of 10 kD. The first dialysis was carried at room temperature for 3 hours and then the formulations were dialyzed overnight at 4° C. The resulting nanoparticle suspension was filtered through 0.2 µm sterile filter (Sarstedt, Nümbrecht, Germany) into glass vials and sealed with a crimp closure.

C. Characterization of Formulations

A Zetasizer Nano ZS (Malvern Instruments Ltd, Malvern, Worcestershire, UK) was used to determine the particle size, the polydispersity index (PDI) and the zeta potential of the modified mRNA nanoparticles in 1×PBS in determining particle size and 15 mM PBS in determining zeta potential.

Ultraviolet-visible spectroscopy was used to determine the concentration of modified mRNA nanoparticle formulation. 100 μL of the diluted formulation in 1×PBS was added to 900 μL of a 4:1 (v/v) mixture of methanol and chloroform. After mixing, the absorbance spectrum of the solution was recorded between 230 nm and 330 nm on a DU 800 spectrophotometer (Beckman Coulter, Beckman Coulter, Inc., Brea, Calif.). The modified RNA concentration in the nanoparticle formulation was calculated based on the extinction coefficient of the modified RNA used in the formulation and on the difference between the absorbance at a wavelength of 260 nm and the baseline value at a wavelength of 330 nm.

QUANT-IT™ RIBOGREEN® RNA assay (Invitrogen Corporation Carlsbad, Calif.) was used to evaluate the encapsulation of modified RNA by the nanoparticle. The samples were diluted to a concentration of approximately 5 μg/mL in TE buffer (10 mM Tris-HCl, 1 mM EDTA, pH 7.5). 50 μL of the diluted samples were transferred to a polystyrene 96 well plate, then either 50 μL of TE buffer or 50 μL of a 2% Triton X-100 solution was added. The plate was incubated at a temperature of 37° C. for 15 minutes. The RIBOGREEN® reagent was diluted 1:100 in TE buffer, 100 μL of this solution was added to each well. The fluorescence intensity was measured using a fluorescence plate reader (Wallac Victor 1420 Multilablel Counter; Perkin Elmer, Waltham, Mass.) at an excitation wavelength of ~480 nm and an emission wavelength of ~520 nm. The fluorescence values of the reagent blank were subtracted from that of each of the samples and the percentage of free modified RNA was determined by dividing the fluorescence intensity of the intact sample (without addition of Triton X-100) by the fluorescence value of the disrupted sample (caused by the addition of Triton X-100).

D. In Vitro Incubation

Human embryonic kidney epithelial (HEK293) and hepatocellular carcinoma epithelial (HepG2) cells (LGC standards GmbH, Wesel, Germany) were seeded on 96-well plates (Greiner Bio-one GmbH, Frickenhausen, Germany) and plates for HEK293 cells were precoated with collagen type1. HEK293 were seeded at a density of 30,000 and HepG2 were seeded at a density of 35,000 cells per well in 100 μl cell culture medium. For HEK293 the cell culture medium was DMEM, 10% FCS, adding 2 mM L-Glutamine, 1 mM Sodiumpyruvate and 1× non-essential amino acids (Biochrom AG, Berlin, Germany) and 1.2 mg/ml Sodiumbicarbonate (Sigma-Aldrich, Munich, Germany) and for HepG2 the culture medium was MEM (Gibco Life Technologies, Darmstadt, Germany), 10% FCS adding 2 mM L-Glutamine, 1 mM Sodiumpyruvate and 1× non-essential amino acids (Biochrom AG, Berlin, Germany. Formulations containing mCherry mRNA (mRNA sequence shown in SEQ ID NO: 33898; polyA tail of approximately 160 nucleotides not shown in sequence; 5'cap, Cap1) were added in quadruplicates directly after seeding the cells and incubated. The mCherry cDNA with the T7 promoter, 5' untranslated region (UTR) and 3' UTR used in in vitro transcription (IVT) is given in SEQ ID NO: 33899. The mCherry mRNA was modified with a 5meC at each cytosine and pseudouridine replacement at each uridine site.

Cells were harvested by transferring the culture media supernatants to a 96-well Pro-Bind U-bottom plate (Beckton Dickinson GmbH, Heidelberg, Germany). Cells were trypsinized with ½ volume Trypsin/EDTA (Biochrom AG, Berlin, Germany), pooled with respective supernatants and fixed by adding one volume PBS/2% FCS (both Biochrom AG, Berlin, Germany)/0.5% formaldehyde (Merck, Darmstadt, Germany). Samples then were submitted to a flow cytometer measurement with a 532 nm excitation laser and the 610/20 filter for PE-Texas Red in a LSRII cytometer (Beckton Dickinson GmbH, Heidelberg, Germany). The mean fluorescence intensity (MFI) of all events and the standard deviation of four independent wells are presented in for samples analyzed.

Example 11

Purification of Nanoparticle Formulations

Nanoparticle formulations of DLin-KC2-DMA and 98N12-5 in HEK293 and HepG2 were tested to determine if the mean fluorescent intensity (MFI) was dependent on the lipid to modified RNA ratio and/or purification. Three formulations of DLin-KC2-DMA and two formulations of 98N12-5 were produced using a syringe pump to the specifications described in Table 13. Purified samples were purified by SEPHADEX™ G-25 DNA grade (GE Healthcare, Sweden). Each formulation before and after purification (aP) was tested at concentration of 250 ng modified RNA per well in a 24 well plate. The percentage of cells that are positive for the marker for FL4 channel (% FL4-positive) when analyzed by the flow cytometer for each formulation and the background sample, and the MFI of the marker for the FL4 channel for each formulation and the background sample are shown in Table 14. The formulations which had been purified had a slightly higher MFI than those formulations tested before purification.

TABLE 13

Formulations

| Formulation # | Lipid | Lipid/RNA wt/wt | Mean size (nm) |
|---|---|---|---|
| NPA-001-1 | DLin-KC2-DMA | 10 | 155 nm PDI: 0.08 |
| NPA-001-1 aP | DLin-KC2-DMA | 10 | 141 nm PDI: 0.14 |
| NPA-002-1 | DLin-KC2-DMA | 15 | 140 nm PDI: 0.11 |
| NPA-002-1 aP | DLin-KC2-DMA | 15 | 125 nm PDI: 0.12 |
| NPA-003-1 | DLin-KC2-DMA | 20 | 114 nm PDI: 0.08 |
| NPA-003-1 aP | DLin-KC2-DMA | 20 | 104 nm PDI: 0.06 |
| NPA-005-1 | 98N12-5 | 15 | 127 nm PDI: 0.12 |
| NPA-005-1 aP | 98N12-5 | 15 | 134 nm PDI: 0.17 |
| NPA-006-1 | 98N12 | 20 | 126 nm PDI: 0.08 |
| NPA-006-1 aP | 98N12 | 20 | 118 nm PDI: 0.13 |

TABLE 14

HEK293 and HepG2, 24-well, 250 ng Modified RNA/well

| Formulation | % FL4-positive | | FL4 MFI | |
|---|---|---|---|---|
| | HEK293 | HepG2 | HEK293 | HepG2 |
| Untreated | 0.33 | 0.40 | 0.25 | 0.30 |
| NPA-001-1 | 62.42 | 5.68 | 1.49 | 0.41 |
| NPA-001-ap | 87.32 | 9.02 | 3.23 | 0.53 |
| NPA-002-1 | 91.28 | 9.90 | 4.43 | 0.59 |
| NPA-002-ap | 92.68 | 14.02 | 5.07 | 0.90 |
| NPA-003-1 | 87.70 | 11.76 | 6.83 | 0.88 |

TABLE 14-continued

HEK293 and HepG2, 24-well, 250 ng Modified RNA/well

| Formulation | % FL4-positive | | FL4 MFI | |
| --- | --- | --- | --- | --- |
| | HEK293 | HepG2 | HEK293 | HepG2 |
| NPA-003-ap | 88.88 | 15.46 | 8.73 | 1.06 |
| NPA-005-1 | 50.60 | 4.75 | 1.83 | 0.46 |
| NPA-005-ap | 38.64 | 5.16 | 1.32 | 0.46 |
| NPA-006-1 | 54.19 | 13.16 | 1.30 | 0.60 |
| NPA-006-ap | 49.97 | 13.74 | 1.27 | 0.61 |

Example 12

Concentration Response Curve

Nanoparticle formulations of 98N12-5 (NPA-005) and DLin-KC2-DMA (NPA-003) were tested at varying concentrations to determine the MFI of FL4 or mCherry (mRNA sequence shown in SEQ ID NO: 33898; polyA tail of approximately 160 nucleotides not shown in sequence; 5'cap, Cap1; fully modified with 5-methylcytosine and pseudouridine) over a range of doses. The formulations tested are outlined in Table 15. To determine the optimal concentration of nanoparticle formulations of 98N12-5, varying concentrations of formulated modified RNA (100 ng, 10 ng, 1.0 ng, 0.1 ng and 0.01 ng per well) were tested in a 24-well plate of HEK293, and the results of the FL4 MFI of each dose are shown in Table 16. Likewise, to determine the optimal concentration of nanoparticle formulations of DLin-KC2-DMA, varying concentrations of formulated modified RNA (250 ng 100 ng, 10 ng, 1.0 ng, 0.1 ng and 0.01 ng per well) were tested in a 24-well plate of HEK293, and the results of the FL4 MFI of each dose are shown in Table 17. Nanoparticle formulations of DLin-KC2-DMA were also tested at varying concentrations of formulated modified RNA (250 ng, 100 ng and 30 ng per well) in a 24 well plate of HEK293, and the results of the FL4 MFI of each dose are shown in Table 18. A dose of 1 ng/well for 98N12-5 and a dose of 10 ng/well for DLin-KC2-DMA were found to resemble the FL4 MFI of the background.

To determine how close the concentrations resembled the background, we utilized a flow cytometer with optimized filter sets for detection of mCherry expression, and were able to obtain results with increased sensitivity relative to background levels. Doses of 25 ng/well, 0.25 ng/well, 0.025 ng/well and 0.0025 ng/well were analyzed for 98N12-5 (NPA-005) and DLin-KC2-DMA (NPA-003) to determine the MFI of mCherry. As shown in Table 19, the concentration of 0.025 ng/well and lesser concentrations are similar to the background MFI level of mCherry which is about 386.125.

TABLE 15

| Formulations | | |
| --- | --- | --- |
| Formulation # | NPA-003 | NPA-005 |
| Lipid | DLin-KC2-DMA | 98N12-5 |
| Lipid/RNA wt/wt | 20 | 15 |
| Mean size | 114 nm PDI: 0.08 | 106 nm PDI: 0.12 |

TABLE 16

HEK293, NPA-005, 24-well, n = 4

| Formulation | FL4 MFI |
| --- | --- |
| Untreated control | 0.246 |
| NPA-005 100 ng | 2.2175 |
| NPA-005 10 ng | 0.651 |
| NPA-005 1.0 ng | 0.28425 |
| NPA-005 0.1 ng | 0.27675 |
| NPA-005 0.01 ng | 0.2865 |

TABLE 17

HEK293, NPA-003, 24-well, n = 4

| Formulation | FL4 MFI |
| --- | --- |
| Untreated control | 0.3225 |
| NPA-003 250 ng | 2.9575 |
| NPA-003 100 ng | 1.255 |
| NPA-003 10 ng | 0.40025 |
| NPA-003 1 ng | 0.33025 |
| NPA-003 0.1 ng | 0.34625 |
| NPA-003 0.01 ng | 0.3475 |

TABLE 18

HEK293, NPA-003, 24-well, n = 4

| Formulation | FL4 MFI |
| --- | --- |
| Untreated control | 0.27425 |
| NPA-003 250 ng | 5.6075 |
| NPA-003 100 ng | 3.7825 |
| NPA-003 30 ng | 1.5525 |

TABLE 19

Concentration and MFI

| | MFI mCherry | |
| --- | --- | --- |
| Formulation | NPA-003 | NPA-005 |
| 25 ng/well | 11963.25 | 12256.75 |
| 0.25 ng/well | 1349.75 | 2572.75 |
| 0.025 ng/well | 459.50 | 534.75 |
| 0.0025 ng/well | 310.75 | 471.75 |

Example 13

Manual Injection and Syringe Pump Formulations

Two formulations of DLin-KC2-DMA and 98N12-5 were prepared by manual injection (MI) and syringe pump injection (SP) and analyzed along with a background sample to compare the MFI of mCherry (mRNA sequence shown in SEQ ID NO: 33898; polyA tail of approximately 160 nucleotides not shown in sequence; 5'cap, Cap1; fully modified with 5-methylcytosine and pseudouridine) of the different formulations. Table 20 shows that the syringe pump formulations had a higher MFI as compared to the manual injection formulations of the same lipid and lipid/RNA ratio.

TABLE 20

Formulations and MFI

| Formulation # | Lipid | Lipid/RNA wt/wt | Mean size (nm) | Method of formulation | MFI |
|---|---|---|---|---|---|
| Untreated Control | N/A | N/A | N/A | N/A | 674.67 |
| NPA-002 | DLin-KC2-DMA | 15 | 140 nm PDI: 0.11 | MI | 10318.25 |
| NPA-002-2 | DLin-KC2-DMA | 15 | 105 nm PDI: 0.04 | SP | 37054.75 |
| NPA-003 | DLin-KC2-DMA | 20 | 114 nm PDI: 0.08 | MI | 22037.5 |
| NPA-003-2 | DLin-KC2-DMA | 20 | 95 nm PDI: 0.02 | SP | 37868.75 |
| NPA-005 | 98N12-5 | 15 | 127 nm PDI: 0.12 | MI | 11504.75 |
| NPA-005-2 | 98N12-5 | 15 | 106 nm PDI: 0.07 | SP | 9343.75 |
| NPA-006 | 98N12-5 | 20 | 126 nm PDI: 0.08 | MI | 11182.25 |
| NPA-006-2 | 98N12-5 | 20 | 93 nm PDI: 0.08 | SP | 5167 |

Example 14

Lipid Nanoparticle Formulations

Formulations of DLin-DMA, DLin-K-DMA, DLin-KC2-DMA, 98N12-5, C12-200 and DLin-MC3-DMA were incubated at a concentration of 60 ng/well or 62.5 ng/well in a plate of HEK293 and 62.5 ng/well in a plate of HepG2 cells for 24 hours to determine the MFI of mCherry (SEQ ID NO: 33898; polyA tail of approximately 160 nucleotides not shown in sequence; 5'cap, Cap1; fully modified with 5-methylcytosine and pseudouridine) for each formulation. The formulations tested are outlined in Table 21 below. As shown in Table 22 for the 60 ng/well and Tables 23, 24 and 25 for the 62.5 ng/well, the formulation of NPA-003 and NPA-018 have the highest mCherry MFI and the formulations of NPA-008, NPA-010 and NPA-013 are most the similar to the background sample mCherry MFI value.

TABLE 21

Formulations

| Formulation # | Lipid | Lipid/RNA wt/wt | Mean size (nm) |
|---|---|---|---|
| NPA-001 | DLin-KC2-DMA | 10 | 155 nm PDI: 0.08 |
| NPA-002 | DLin-KC2-DMA | 15 | 140 nm PDI: 0.11 |
| NPA-002-2 | DLin-KC2-DMA | 15 | 105 nm PDI: 0.04 |
| NPA-003 | DLin-KC2-DMA | 20 | 114 nm PDI: 0.08 |
| NPA-003-2 | DLin-KC2-DMA | 20 | 95 nm PDI: 0.02 |
| NPA-005 | 98N12-5 | 15 | 127 nm PDI: 0.12 |
| NPA-006 | 98N12-5 | 20 | 126 nm PDI: 0.08 |
| NPA-007 | DLin-DMA | 15 | 148 nm PDI: 0.09 |
| NPA-008 | DLin-K-DMA | 15 | 121 nm PDI: 0.08 |
| NPA-009 | C12-200 | 15 | 138 nm PDI: 0.15 |
| NPA-010 | DLin-MC3-DMA | 15 | 126 nm PDI: 0.09 |
| NPA-012 | DLin-DMA | 20 | 86 nm PDI: 0.08 |
| NPA-013 | DLin-K-DMA | 20 | 104 nm PDI: 0.03 |
| NPA-014 | C12-200 | 20 | 101 nm PDI: 0.06 |
| NPA-015 | DLin-MC3-DMA | 20 | 109 nm PDI: 0.07 |

TABLE 22

HEK293, 96-well, 60 ng Modified RNA/well

| Formulation | MFI mCherry |
|---|---|
| Untreated | 871.81 |
| NPA-001 | 6407.25 |
| NPA-002 | 14995 |
| NPA-003 | 29499.5 |
| NPA-005 | 3762 |
| NPA-006 | 2676 |
| NPA-007 | 9905.5 |
| NPA-008 | 1648.75 |
| NPA-009 | 2348.25 |
| NPA-010 | 4426.75 |
| NPA-012 | 11466 |
| NPA-013 | 2098.25 |
| NPA-014 | 3194.25 |
| NPA-015 | 14524 |

TABLE 23

HEK293, 62.5 ng/well

| Formulation | MFI mCherry |
|---|---|
| Untreated | 871.81 |
| NPA-001 | 6407.25 |
| NPA-002 | 14995 |
| NPA-003 | 29499.5 |
| NPA-005 | 3762 |
| NPA-006 | 2676 |
| NPA-007 | 9905.5 |
| NPA-008 | 1648.75 |
| NPA-009 | 2348.25 |
| NPA-010 | 4426.75 |
| NPA-012 | 11466 |
| NPA-013 | 2098.25 |
| NPA-014 | 3194.25 |
| NPA-015 | 14524 |

TABLE 24

HEK293, 62.5 ng/well

| Formulation | MFI mCherry |
|---|---|
| Untreated | 295 |
| NPA-007 | 3504 |
| NPA-012 | 8286 |
| NPA-017 | 6128 |
| NPA-003-2 | 17528 |
| NPA-018 | 34142 |
| NPA-010 | 1095 |
| NPA-015 | 5859 |
| NPA-019 | 3229 |

TABLE 25

HepG2, 62.5 ng/well

| Formulation | MFI mCherry |
|---|---|
| Study 1 | |
| Untreated | 649.94 |
| NPA-001 | 6006.25 |
| NPA-002 | 8705 |
| NPA-002-2 | 15860.25 |
| NPA-003 | 15059.25 |
| NPA-003-2 | 28881 |
| NPA-005 | 1676 |
| NPA-006 | 1473 |
| NPA-007 | 15678 |
| NPA-008 | 2976.25 |
| NPA-009 | 961.75 |
| NPA-010 | 3301.75 |
| NPA-012 | 18333.25 |
| NPA-013 | 5853 |
| NPA-014 | 2257 |
| NPA-015 | 16225.75 |
| Study 2 | |
| Untreated control | 656 |
| NPA-007 | 16798 |
| NPA-012 | 21993 |
| NPA-017 | 20377 |
| NPA-003-2 | 35651 |
| NPA-018 | 40154 |
| NPA-010 | 2496 |
| NPA-015 | 19741 |
| NPA-019 | 16373 |

Example 15

In Vivo Formulation Studies

Rodents (n=5) are administered intravenously, subcutaneously or intramuscularly a single dose of a formulation containing a modified mRNA and a lipid. The modified mRNA administered to the rodents is selected from G-CSF (mRNA sequence shown in SEQ ID NO: 33897; polyA tail of approximately 160 nucleotides not shown in sequence; 5'cap, Cap1), erythropoietin (EPO) (mRNA sequence shown in SEQ ID NO: 33900; polyA tail of approximately 160 nucleotides not shown in sequence; 5'cap, Cap1), Factor IX (mRNA sequence shown in SEQ ID NO: 33901; polyA tail of approximately 160 nucleotides not shown in sequence; 5'cap, Cap1) or mCherry (mRNA sequence shown in SEQ ID NO: 33898; polyA tail of approximately 160 nucleotides not shown in sequence; 5'cap, Cap1). The erythropoietin cDNA with the T7 promoter, 5' untranslated region (UTR) and 3' UTR used in in vitro transcription (IVT) is given in SEQ ID NO: 33902 and SEQ ID NO: 33903.

Each formulation also contains a lipid which is selected from one of DLin-DMA, DLin-K-DMA, DLin-KC2-DMA, 98N12-5, C12-200, DLin-MC3-DMA, reLNP, ATUPLEX®, DACC and DBTC. The rodents are injected with 100 ug, 10 ug or 1 ug of the formulated modified mRNA and samples are collected at specified time intervals.

Serum from the rodents administered formulations containing human G-CSF modified mRNA are measured by specific G-CSF ELISA and serum from mice administered human factor IX modified RNA is analyzed by specific factor IX ELISA or chromogenic assay. The liver and spleen from the mice administered with mCherry modified mRNA are analyzed by immunohistochemistry (IHC) or fluorescence-activated cell sorting (FACS). As a control, a group of mice are not injected with any formulation and their serum and tissue are collected analyzed by ELISA, FACS and/or IHC.

A. Time Course

The rodents are administered formulations containing at least one modified mRNA to study the time course of protein expression for the administered formulation. The rodents are bled at specified time intervals prior to and after administration of the modified mRNA formulations to determine protein expression and complete blood count. Samples are also collected from the site of administration of rodents administered modified mRNA formulations subcutaneously and intramuscularly to determine the protein expression in the tissue.

B. Dose Response

The rodents are administered formulations containing at least one modified mRNA to determine dose response of each formulation. The rodents are bled at specified time intervals prior to and after administration of the modified mRNA formulations to determine protein expression and complete blood count. The rodents are also sacrificed to analyze the effect of the modified mRNA formulation on the internal tissue. Samples are also collected from the site of administration of rodents administered modified mRNA formulations subcutaneously and intramuscularly to determine the protein expression in the tissue.

C. Toxicity

The rodents are administered formulations containing at least one modified mRNA to study toxicity of each formulation. The rodents are bled at specified time intervals prior to and after administration of the modified mRNA formulations to determine protein expression and complete blood count. The rodents are also sacrificed to analyze the effect of the modified mRNA formulation on the internal tissue. Samples are also collected from the site of administration of rodents administered modified mRNA formulations subcutaneously and intramuscularly to determine the protein expression in the tissue.

Example 16

PLGA Microsphere Formulations

Optimization of parameters used in the formulation of PLGA microspheres may allow for tunable release rates and high encapsulation efficiencies while maintaining the integrity of the modified RNA encapsulated in the microspheres. Parameters such as, but not limited to, particle size, recovery rates and encapsulation efficiency may be optimized to achieve the optimal formulation.

A. Synthesis of PLGA Microspheres

Polylacticglycolic acid (PLGA) microspheres were synthesized using the water/oil/water double emulsification methods known in the art using PLGA (Lactel, Cat#B6010-2, inherent viscosity 0.55-0.75, 50:50 LA:GA), polyvinylalcohol (PVA) (Sigma, Cat#348406-25G, MW 13-23 k) dichloromethane and water. Briefly, 0.1 ml of water (W1) was added to 2 ml of PLGA dissolved in dichloromethane (DCM) (O1) at concentrations ranging from 50-200 mg/ml of PLGA. The W1/O1 emulsion was homogenized (IKA Ultra-Turrax Homogenizer, T18) for 30 seconds at speed 4 (15,000 rpm). The W1/O1 emulsion was then added to 100 to 200 ml of 0.3 to 1% PVA (W2) and homogenized for 1 minute at varied speeds. Formulations were left to stir for 3 hours and then washed by centrifugation (20-25 min, 4,000 rpm, 4° C.). The supernatant was discarded and the PLGA pellets were resuspended in 5-10 ml of water, which was repeated 2×. Average particle size (represents 20-30 particles) for each formulation was determined by microscopy after washing. Table 26 shows that an increase in the PLGA concentration led to larger sized microspheres. A PLGA concentration of 200 mg/mL gave an average particle size of 14.8 μm, 100 mg/mL was 8.7 μm, and 50 mg/mL of PLGA gave an average particle size of 4.0 μm.

TABLE 26

Varied PLGA Concentration

| Sample ID | O1 Volume (mL) | PLGA Concentration (mg/mL) | W2 Volume (mL) | PVA Concentration (%) | Speed | Average Size (μm) |
|---|---|---|---|---|---|---|
| 1 | 2 | 200 | 100 | 0.3 | 5 | 14.8 |
| 2 | 2 | 100 | 100 | 0.3 | 5 | 8.7 |
| 3 | 2 | 50 | 100 | 0.3 | 5 | 4.0 |

Table 27 shows that decreasing the homogenization speed from 5 (~20,000 rpm) to speed 4 (~15,000 rpm) led to an increase in particle size from 14.8 μm to 29.7 μm.

TABLE 27

Varied Homogenization Speed

| Sample ID | O1 Volume (mL) | PLGA Concentration (mg/mL) | W2 Volume (mL) | PVA Concentration (%) | Speed | Average Size (μm) |
|---|---|---|---|---|---|---|
| 1 | 2 | 200 | 100 | 0.3 | 5 | 14.8 |
| 4 | 2 | 200 | 100 | 0.3 | 4 | 29.7 |

Table 28 shows that increasing the W2 volume (i.e. increasing the ratio of W2:O1 from 50:1 to 100:1), decreased average particle size slightly. Altering the PVA concentration from 0.3 to 1 wt % had little impact on PLGA microsphere size.

TABLE 28

Varied W2 Volume and Concentration

| Sample ID | O1 Volume (mL) | PLGA Concentration (mg/mL) | W2 Volume (mL) | PVA Concentration (%) | Speed | Average Size (μm) |
|---|---|---|---|---|---|---|
| 1 | 2 | 200 | 100 | 0.3 | 5 | 14.8 |
| 5 | 2 | 200 | 200 | 0.3 | 5 | 11.7 |
| 6 | 2 | 200 | 190 | 0.3 | 5 | 11.4 |
| 7 | 2 | 200 | 190 | 1.0 | 5 | 12.3 |

B. Encapsulation of Modified mRNA

Modified G-CSF mRNA (mRNA sequence shown in SEQ ID NO: 33897; polyA tail of approximately 160 nucleotides not shown in sequence; 5'cap, Cap1; fully modified with 5-methylcytosine and pseudouridine) was dissolved in water at a concentration of 2 mg/ml (W3). Three batches of PLGA microsphere formulations were made as described above with the following parameters: 0.1 ml of W3 at 2 mg/ml, 1.6 ml of O1 at 200 mg/ml, 160 ml of W2 at 1%, and homogenized at a speed of 4 for the first emulsion (W3/O1) and homogenized at a speed of 5 for the second emulsion (W3/O1/W2). After washing by centrifugation, the formulations were frozen in liquid nitrogen and then lyophilized for 3 days. To test the encapsulation efficiency of the formulations, the lyophilized material was deformulated in DCM for 6 hours followed by an overnight extraction in water. The modified RNA concentration in the samples was then determined by OD260. Encapsulation efficiency was calculated by taking the actual amount of modified RNA and dividing by the starting amount of modified RNA. In the three batches tested, there was an encapsulation efficiency of 59.2, 49.8 and 61.3.

C. Integrity of Modified mRNA Encapsulated in PLGA Microspheres

Modified Factor IX mRNA (mRNA sequence shown in SEQ ID NO: 33901; polyA tail of approximately 160 nucleotides not shown in sequence; 5'cap, Cap1; fully modified with 5-methylcytosine and pseudouridine) was dissolved in water at varied concentrations (W4) to vary the weight percent loading in the formulation (mg modified RNA/mg PLGA*100) and to determine encapsulation efficiency. The parameters in Table 28 were used to make four different batches of PLGA microsphere formulations with a homogenization speed of 4 for the first emulsion (W4/O1) and a homogenization speed of 5 for the second emulsion (W4/O1/W2).

TABLE 28

Factor IX PLGA Microsphere Formulation Parameters

| ID | W4 Volume (uL) | Factor IX Concentration (mg/ml) | Factor IX Amount (ug) | O1 Volume (ml) | PLGA Concentration (mg/ml) | W2 Volume (ml) | PVA Concentration (%) | Weight % (wt %) Loading |
|---|---|---|---|---|---|---|---|---|
| A | 100 | 2.0 | 200.0 | 2.0 | 200 | 200 | 1.0 | 0.05 |
| B | 100 | 4.0 | 400.0 | 2.0 | 200 | 200 | 1.0 | 0.10 |
| C | 400 | 2.0 | 800.0 | 2.0 | 200 | 200 | 1.0 | 0.20 |
| D | 400 | 4.0 | 1600.0 | 2.0 | 200 | 200 | 1.0 | 0.40 |

After lyophilization, PLGA microspheres were weighed out in 2 ml eppendorf tubes to correspond to ~10 ug of modified RNA. Lyophilization was found to not destroy the overall structure of the PLGA microspheres. To increase weight percent loading (wt %) for the PLGA microspheres, increasing amounts of modified RNA were added to the samples. PLGA microspheres were deformulated by adding 1.0 ml of DCM to each tube and then shaking the samples for 6 hours. For modified RNA extraction, 0.5 ml of water was added to each sample and the samples were shaken overnight before the concentration of modified RNA in the samples was determined by OD260. To determine the recovery of the extraction process, unformulated Factor IX modified mRNA (mRNA sequence shown in SEQ ID NO: 33901; polyA tail of approximately 160 nucleotides not shown in sequence; 5'cap, Cap1; fully modified with 5-methylcytosine and pseudouridine) (deformulation control) was spiked into DCM and was subjected to the deformulation process. Table 29 shows the loading and encapsulation efficiency for the samples. All encapsulation efficiency samples were normalized to the deformulation control.

TABLE 29

Weight Percent Loading and Encapsulation Efficiency

| ID | Theoretical modified RNA loading (wt %) | Actual modified RNA loading (wt %) | Encapsulation Efficiency (%) |
|---|---|---|---|
| A | 0.05 | 0.06 | 97.1 |
| B | 0.10 | 0.10 | 85.7 |
| C | 0.20 | 0.18 | 77.6 |
| D | 0.40 | 0.31 | 68.1 |
| Control | — | — | 100.0 |

D. Release Study of Modified mRNA Encapsulated in PLGA Microspheres

Figure 4:
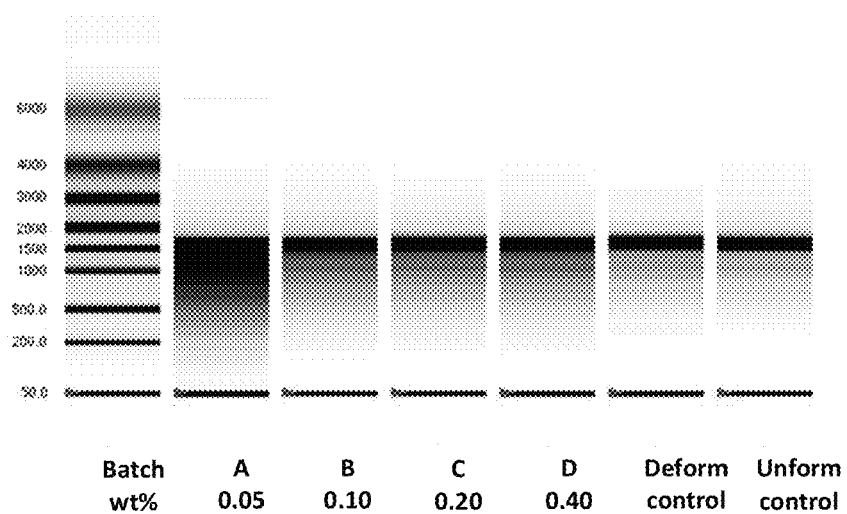
FIG. 4 is a gel profile of modified mRNA encapsulated in PLGA microspheres.

PLGA microspheres formulated with Factor IX modified mRNA (mRNA sequence shown in SEQ ID NO: 33901; polyA tail of approximately 160 nucleotides not shown in sequence; 5'cap, Cap1; fully modified with 5-methylcytosine and pseudouridine) were deformulated as described above and the integrity of the extracted modified RNA was determined by automated electrophoresis (Bio-Rad Experion). The extracted modified mRNA was compared against unformulated modified mRNA and the deformulation control in order to test the integrity of the encapsulated modified mRNA. As shown in FIG. 4, the majority of modRNA was intact for batch ID A, B, C and D, for the deformulated control (Deform control) and the unformulated control (Unform control).

E. Protein Expression of Modified mRNA Encapsulated in PLGA Microspheres

PLGA microspheres formulated with Factor IX modified mRNA (mRNA sequence shown in SEQ ID NO: 33901; polyA tail of approximately 160 nucleotides not shown in sequence; 5'cap, Cap1; fully modified with 5-methylcytosine and pseudouridine) were deformulated as described above and the protein expression of the extracted modified RNA was determined by an in vitro transfection assay. HEK293 cells were reverse transfected with 250 ng of Factor IX modified RNA complexed with RNAiMAX (Invitrogen) in triplicate.

Factor IX modified RNA was diluted in nuclease-free water to a concentration of 25 ng/µl and RNAiMAX was diluted 13.3× in serum-free EMEM. Equal volumes of diluted modified RNA and diluted RNAiMAX were mixed together and were allowed to stand for 20 to 30 minutes at room temperature. Subsequently, 20 µl of the transfection mix containing 250 ng of Factor IX modified RNA was added to 80 µl of a cell suspension containing 30,000 cells. Cells were then incubated for 16 h in a humidified 37° C./5% $CO_2$ cell culture incubator before harvesting the cell culture supernatant. Factor IX protein expression in the cell supernatant was analyzed by an ELISA kit specific for Factor IX (Molecular Innovations, Cat #HFIXKT-TOT) and the protein expression is shown in Table 30. In all PLGA microsphere batches tested, Factor IX modified RNA remained active and expressed Factor IX protein after formulation in PLGA microspheres and subsequent deformulation.

TABLE 30

Protein Expression

| Sample | Factor IX Protein Expression (ng/ml) |
|---|---|
| Batch A | 0.83 |
| Batch B | 1.83 |
| Batch C | 1.54 |
| Batch D | 2.52 |
| Deformulated Control | 4.34 |
| Unformulated Control | 3.35 |

F. Release Study of Modified mRNA Encapsulated in PLGA Microspheres

PLGA microspheres formulated with Factor IX modified RNA (mRNA sequence shown in SEQ ID NO: 33901; polyA tail of approximately 160 nucleotides not shown in sequence; 5'cap, Cap1; fully modified with 5-methylcytosine and pseudouridine) were resuspended in water to a PLGA microsphere concentration of 24 mg/ml. After resuspension, 150 ul of the PLGA microsphere suspension was aliquoted into eppendorf tubes. Samples were kept incubating and shaking at 37° C. during the course of the study. Triplicate samples were pulled at 0.2, 1, 2, 8, 14, and 21 days. To determine the amount of modified RNA released from the PLGA microspheres, samples were centrifuged, the supernatant was removed, and the modified RNA concentration in the supernatant was determined by OD 260. The percent release, shown in Table 31, was calculated based on the total amount of modified RNA in each sample. After 31 days, 96% of the Factor IX modified RNA was released from the PLGA microsphere formulations.

TABLE 31

Percent Release

| Time (days) | % Release |
|---|---|
| 0 | 0.0 |
| 0.2 | 27.0 |
| 1 | 37.7 |
| 2 | 45.3 |
| 4 | 50.9 |
| 8 | 57.0 |
| 14 | 61.8 |
| 21 | 75.5 |
| 31 | 96.4 |

G. Particle Size Reproducibility of PLGA Microspheres

Three batches of Factor IX modified mRNA (mRNA sequence shown in SEQ ID NO: 33901; polyA tail of approximately 160 nucleotides not shown in sequence; 5'cap, Cap1; fully modified with 5-methylcytosine and pseudouridine) PLGA microspheres were made using the same conditions described for Batch D, shown in Table 28, (0.4 ml of W4 at 4 mg/ml, 2.0 ml of O1 at 200 mg/ml, 200 ml of W2 at 1%, and homogenized at a speed of 5 for the W4/O1/W2 emulsion). To improve the homogeneity of the PLGA microsphere suspension, filtration was incorporated prior to centrifugation. After stirring for 3 hours and before centrifuging, all formulated material was passed through a 100 µm nylon mesh strainer (Fisherbrand Cell Strainer, Cat #22-363-549) to remove larger aggregates. After washing and resuspension with water, 100-200 µl of a PLGA microspheres sample was used to measure particle size of the formulations by laser diffraction (Malvern Mastersizer2000). The particle size of the samples is shown in Table 32.

TABLE 32

Particle Size Summary

| ID | D10 (μm) | D50 (μm) | D90 (μm) | Volume Weighted Mean (um) | Filtration |
|---|---|---|---|---|---|
| Control | 19.2 | 62.5 | 722.4 | 223.1 | No |
| A | 9.8 | 31.6 | 65.5 | 35.2 | Yes |
| B | 10.5 | 32.3 | 66.9 | 36.1 | Yes |
| C | 10.8 | 35.7 | 79.8 | 41.4 | Yes |

Results of the 3 PLGA microsphere batches using filtration were compared to a PLGA microsphere batch made under the same conditions without filtration. The inclusion of a filtration step before washing reduced the mean particle size and demonstrated a consistent particle size distribution between 3 PLGA microsphere batches.

H. Serum Stability of Factor IX PLGA Microspheres

Factor IX mRNA mRNA (mRNA sequence shown in SEQ ID NO: 33901; polyA tail of approximately 160 nucleotides not shown in sequence; 5'cap, Cap1; fully modified with 5-methylcytosine and pseudouridine) in buffer (TE) or 90% serum (Se), or Factor IX mRNA in PLGA in buffer, 90% serum or 1% serum was incubated in buffer, 90% serum or 1% serum at an mRNA concentration of 50 ng/ul in a total volume of 70 ul. The samples were removed at 0, 30, 60 or 120 minutes. RNases were inactivated with proteinase K digestion for 20 minutes at 55° C. by adding 25 ul of 4× proteinase K buffer (0.4 ml 1M TRIS-HCl pH 7.5, 0.1 ml 0.5M EDTA, 0.12 ml 5M NaCl, and 0.4 ml 10% SDS) and 8 ul of proteinase K at 20 mg/ml. The Factor IX mRNA was precipitated (add 250 ul 95% ethanol for 1 hour, centrifuge for 10 min at 13 k rpm and remove supernatant, add 200 ul 70% ethanol to the pellet, centrifuge again for 5 min at 13 k rpm and remove supernatant and resuspend the pellet in 70 ul water) or extracted from PLGA microspheres (centrifuge 5 min at 13 k rpm and remove supernatant, wash pellet with 1 ml water, centrifuge 5 min at 13 k rpm and remove supernatant, add 280 ul dichloromethane to the pellet and shake for 15 minutes, add 70 ul water and then shake for 2 hours and remove the aqueous phase) before being analyzed by bioanalyzer. PLGA microspheres protect Factor IX modified mRNA from degradation in 90% and 1% serum over 2 hours. Factor IX modified mRNA completely degrades in 90% serum at the initial time point.

Example 17

Lipid Nanoparticle In Vivo Studies

G-CSF (cDNA with the T7 promoter, 5' Untranslated region (UTR) and 3'UTR used in in vitro transcription is given in SEQ ID NO: 33896. mRNA sequence shown in SEQ ID NO: 33897; polyA tail of approximately 160 nucleotides not shown in sequence; 5'cap, Cap 1; fully modified with 5-methylcytosine and pseudouridine) and Factor IX (cDNA with the T7 promoter, 5' UTR and 3'UTR used in in vitro transcription is given in SEQ ID NO: 33904. mRNA sequence shown in SEQ ID NO: 33901; polyA tail of approximately 160 nucleotides not shown in sequence; 5'cap, Cap 1; fully modified with 5-methylcytosine and pseudouridine) modified mRNA were formulated as lipid nanoparticles (LNPs) using the syringe pump method. The LNPs were formulated at a 20:1 weight ratio of total lipid to modified mRNA with a final lipid molar ratio of 50:10:38.5:1.5 (DLin-KC2-DMA: DSPC: Cholesterol: PEG-c-DOMG). Formulations, listed in Table 33, were characterized by particle size, zeta potential, and encapsulation.

TABLE 33

Formulations

| | Formulation # | |
|---|---|---|
| | NPA-029-1 | NPA-030-1 |
| Modified mRNA | Factor IX | G-CSF |
| Mean size | 91 nm | 106 nm |
| | PDI: 0.04 | PDI: 0.06 |
| Zeta at pH 7.4 | 1.8 mV | 0.9 mV |
| Encaps. (RiboGr) | 92% | 100% |

LNP formulations were administered to mice (n=5) intravenously at a modified mRNA dose of 100, 10, or 1 ug. Mice were sacrificed at 8 hrs after dosing. Serum was collected by cardiac puncture from mice that were administered with G-CSF or Factor IX modified mRNA formulations. Protein expression was determined by ELISA.

There was no significant body weight loss (<5%) in the G-CSF or Factor IX dose groups. Protein expression for G-CSF or Factor IX dose groups was determined by ELISA from a standard curve. Serum samples were diluted (about 20-2500× for G-CSF and about 10-250× for Factor IX) to ensure samples were within the linear range of the standard curve. As shown in Table 34, G-CSF protein expression determined by ELISA was approximately 17, 1200, and 4700 ng/ml for the 1, 10, and 100 ug dose groups, respectively. As shown in Table 35, Factor IX protein expression determined by ELISA was approximately 36, 380, and 3000-11000 ng/ml for the 1, 10, and 100 ug dose groups, respectively.

TABLE 34

G-CSF Protein Expression

| Dose (ug) | Conc (ng/ml) | Dilution Factor | Sample Volume |
|---|---|---|---|
| 1 | 17.73 | 20× | 5 ul |
| 10 | 1204.82 | 2500× | 0.04 ul |
| 100 | 4722.20 | 2500× | 0.04 ul |

TABLE 35

Factor IX Protein Expression

| Dose (ug) | Conc (ng/ml) | Dilution Factor | Sample Volume |
|---|---|---|---|
| 1 | 36.05 | 10× | 5 ul |
| 10 | 383.04 | 10× | 5 ul |
| 100* | 3247.75 | 50× | 1 ul |
| 100* | 11177.20 | 250× | 0.2 ul |

As shown in Table 36, the LNP formulations described above have about a 10,000-100,000-fold increase in protein production compared to an administration of an intravenous (IV)-lipoplex formulation for the same dosage of modified mRNA and intramuscular (IM) or subcutaneous (SC) administration of the same dose of modified mRNA in saline. As used in Table 36, the symbol "~" means about.

TABLE 36

Protein Production

| G-CSF | Dose (ug) | Serum Concentration (pg/ml) 8-12 hours after administration |
|---|---|---|
| IM | 100 | ~20-80 |
| SC | 100 | ~10-40 |
| IV (Lipoplex) | 100 | ~30 |
| IV (LNP) | 100 | ~5,000,000 |
| IV (LNP) | 10 | ~1,000,000 |
| IV (LNP) | 1 | ~20,000 |

| Factor IX | Dose (ug) | Serum Concentration (ng/ml) 8-12 hours after administration |
|---|---|---|
| IM | 2 × 100 | ~1.6 ng/ml |
| IV (LNP) | 100 | ~3,000-10,000 ng/ml |
| IV (LNP) | 10 | ~400 ng/ml |
| IV (LNP) | 1 | ~40 ng/ml |

Materials and Methods for Examples 18-23

G-CSF (mRNA sequence shown in SEQ ID NO: 33897; polyA tail of approximately 160 nulceotides not shown in sequence; 5'cap, Cap 1; fully modified with 5-methylcytosine and pseudouridine) and EPO (mRNA sequence shown in SEQ ID NO: 33900; polyA tail of approximately 160 nulceotides not shown in sequence; 5'cap, Cap 1; fully modified with 5-methylcytosine and pseudouridine) modified mRNA were formulated as lipid nanoparticles (LNPs) using the syringe pump method. The LNPs were formulated at a 20:1 weight ratio of total lipid to modified mRNA with a final lipid molar ratio of 50:10:38.5:1.5 (DLin-KC2-DMA: DSPC: Cholesterol: PEG-c-DOMG). Formulations, listed in Table 37, were characterized by particle size, zeta potential, and encapsulation.

TABLE 37

Formulations

| | Formulation # | |
|---|---|---|
| | NPA-030-2 | NPA-060-1 |
| Modified mRNA | G-CSF | EPO |
| Mean size | 84 nm | 85 nm |
| | PDI: 0.04 | PDI: 0.03 |
| Zeta at pH 7.4 | 0.8 mV | 1.5 mV |
| Encapsulation (RiboGreen) | 95% | 98% |

Example 18

Lipid Nanoparticle In Vivo Studies with Modified mRNA

LNP formulations, shown in Table 37 (above), were administered to rats (n=5) intravenously (IV), intramuscularly (IM) or subcutaneously (SC) at a single modified mRNA dose of 0.05 mg/kg. A control group of rats (n=4) was untreated. The rats were bled at 2 hours, 8 hours, 24 hours, 48 hours and 96 hours and after they were administered with G-CSF or EPO modified mRNA formulations to determine protein expression using ELISA. The rats administered EPO modified mRNA intravenously were also bled at 7 days.

As shown in Table 38, EPO protein expression in the rats intravenously administered modified EPO mRNA was detectable out to 5 days. G-CSF in the rats intravenously administered modified G-CSF mRNA was detectable to 7 days. Subcutaneous and intramuscular administration of EPO modified mRNA was detectable to at least 24 hours and G-CSF modified mRNA was detectable to at least 8 hours. In Table 38, "OSC" refers to values that were outside the standard curve and "NT" means not tested.

TABLE 38

G-CSF and EPO Protein Expression

| Route | Time | EPO Serum Concentration (pg/ml) | G-CSF Serum Concentration (pg/ml) |
|---|---|---|---|
| IV | 2 hours | 36,981.0 | 31,331.9 |
| IV | 8 hours | 62,053.3 | 70,532.4 |
| IV | 24 hours | 42,077.0 | 5,738.6 |
| IV | 48 hours | 5,561.5 | 233.8 |
| IV | 5 days | 0.0 | 60.4 |
| IV | 7 days | 0.0 | NT |
| IM | 2 hours | 1395.4 | 1620.4 |
| IM | 8 hours | 8974.6 | 7910.4 |
| IM | 24 hours | 4678.3 | 893.3 |
| IM | 48 hours | NT | OSC |
| IM | 5 days | NT | OSC |
| SC | 2 hours | 386.2 | 80.3 |
| SC | 8 hours | 985.6 | 164.2 |
| SC | 24 hours | 544.2 | OSC |
| SC | 48 hours | NT | OSC |
| SC | 5 days | NT | OSC |
| Untreated | All bleeds | 0 | 0 |

Example 19

Time Course In Vivo Study

LNP formulations, shown in 37 (above), were administered to mice (n=5) intravenously (IV) at a single modified mRNA dose of 0.5, 0.05 or 0.005 mg/kg. The mice were bled at 8 hours, 24 hours, 72 hours and 6 days after they were administered with G-CSF or EPO modified mRNA formulations to determine protein expression using ELISA.

As shown in Table 39, EPO and G-CSF protein expression in the mice administered with the modified mRNA intravenously was detectable out to 72 hours for the mice dosed with 0.005 mg/kg and 0.05 mg/kg of modified mRNA and out to 6 days for the mice administered the EPO modified mRNA. In Table 39, ">" means greater than and "ND" means not detected.

TABLE 39

Protein Expression

| Dose (mg/kg) | Time | EPO Serum Concentration (pg/ml) | G-CSF Serum Concentration (pg/ml) |
|---|---|---|---|
| 0.005 | 8 hours | 12,508.3 | 11,550.6 |
| 0.005 | 24 hours | 6,803.0 | 5,068.9 |
| 0.005 | 72 hours | ND | ND |
| 0.005 | 6 days | ND | ND |
| 0.05 | 8 hours | 92,139.9 | 462,312.5 |
| 0.05 | 24 hours | 54,389.4 | 80,903.8 |
| 0.05 | 72 hours | ND | ND |
| 0.05 | 6 days | ND | ND |
| 0.5 | 8 hours | 498,515.3 | >1,250,000 |
| 0.5 | 24 hours | 160,566.3 | 495,812.5 |
| 0.5 | 72 hours | 3,492.5 | 1,325.6 |
| 0.5 | 6 days | 21.2 | ND |

Example 20

LNP Formulations In Vivo Study in Rodents

A. LNP Formulations in Mice

LNP formulations, shown in Table 37 (above), were administered to mice (n=4) intravenously (IV) at a single modified mRNA dose 0.05 mg/kg or 0.005 mg/kg. There was also 3 control groups of mice (n=4) that were untreated. The mice were bled at 2 hours, 8 hours, 24 hours, 48 hours and 72 hours after they were administered with G-CSF or EPO modified mRNA formulations to determine the protein expression. Protein expression of G-CSF and EPO were determined using ELISA.

As shown in Table 40, EPO and G-CSF protein expression in the mice was detectable at least out to 48 hours for the mice that received a dose of 0.005 mg/kg modified RNA and 72 hours for the mice that received a dose of 0.05 mg/kg modified RNA. In Table 40, "OSC" refers to values that were outside the standard curve and "NT" means not tested.

TABLE 40

Protein Expression in Mice

| Dose (mg/kg) | Time | EPO Serum Concentration (pg/ml) | G-CSF Serum Concentration (pg/ml) |
|---|---|---|---|
| 0.005 | 2 hours | OSC | 3,447.8 |
| 0.005 | 8 hours | 1,632.8 | 11,454.0 |
| 0.005 | 24 hours | 1,141.0 | 4,960.2 |
| 0.005 | 48 hours | 137.4 | 686.4 |
| 0.005 | 72 hours | 0 | NT |
| 0.05 | 2 hours | 10,027.3 | 20,951.4 |
| 0.05 | 8 hours | 56,547.2 | 70,012.8 |
| 0.05 | 24 hours | 25,027.3 | 19,356.2 |
| 0.05 | 48 hours | 1,432.3 | 1,963.0 |
| 0.05 | 72 hours | 82.2 | 47.3 |

B. LNP Formulations in Rats

LNP formulations, shown in Table 37 (above), are administered to rats (n=4) intravenously (IV) at a single modified mRNA dose 0.05 mg/kg. There is also a control group of rats (n=4) that are untreated. The rats are bled at 2 hours, 8 hours, 24 hours, 48 hours, 72 hours, 7 days and 14 days after they were administered with G-CSF or EPO modified mRNA formulations to determine the protein expression. Protein expression of G-CSF and EPO are determined using ELISA.

Example 21

Early Time Course Study of LNPs

LNP formulations, shown in Table 37 (above), are administered to mammals intravenously (IV), intramuscularly (IM) or subcutaneously (SC) at a single modified mRNA dose of 0.5 mg/kg, 0.05 mg/kg or 0.005 mg/kg. A control group of mammals are not treated. The mammals are bled at 5 minutes, 10 minutes, 20 minutes, 30 minutes, 45 minutes, 1 hour, 1.5 hours and/or 2 hours after they are administered with the modified mRNA LNP formulations to determine protein expression using ELISA. The mammals are also bled to determine the complete blood count such as the granulocyte levels and red blood cell count.

Example 22

Non-Human Primate In Vivo Study

LNP formulations, shown in Table 37 (above), were administered to non-human primates (NHP) (cynomolgus monkey) (n=2) as a bolus intravenous injection (IV) over approximately 30 seconds using a hypodermic needle, which may be attached to a syringe/abbocath or butterfly if needed. The NHP were administered a single modified mRNA IV dose of 0.05 mg/kg of EPO or G-CSF or 0.005 mg/kg of EPO in a dose volume of 0.5 mL/kg. The NHPs were bled 5-6 days before dosing with the modified mRNA LNP formulations to determine protein expression in the serum and a baseline complete blood count. After administration with the modified mRNA formulation the NHP were bled at 8, 24, 48 and 72 hours to determined protein expression. At 24 and 72 hours after administration the complete blood count of the NHP was also determined. Protein expression of G-CSF and EPO was determined by ELISA. Urine from the NHPs was collected over the course of the entire experiment and analyzed to evaluate clinical safety. Samples were collected from the NHPs after they were administered with G-CSF or EPO modified mRNA formulations to determine protein expression using ELISA. Clinical chemistry, hematology, urinalysis and cytokines of the non-human primates were also analyzed.

As shown in Table 41, EPO protein expression in the NHPs administered 0.05 mg/kg is detectable out to 72 hours and the 0.005 mg/kg dosing of the EPO formulation is detectable out to 48 hours. In Table 41, the "<" means less than a given value. G-CSF protein expression was seen out to 24 hours after administration with the modified mRNA formulation. Preliminarily, there was an increase in granulocytes and reticulocytes levels seen in the NHP after administration with the modified mRNA formulations.

TABLE 41

Protein Expression in Non-Human Primates

| Modified mRNA | Dose (mg/kg) | Time | Female NHP Serum tration (pg/ml) | Male NHP Serum Concentration (pg/ml) | Average Serum Conentration (pg/ml) |
|---|---|---|---|---|---|
| G-CSF | 0.05 | Pre-bleed | 0 | 0 | 0 |
|  |  | 8 hours | 3289 | 1722 | 2,506 |
|  |  | 24 hours | 722 | 307 | 515 |
|  |  | 48 hours | 0 | 0 | 0 |
|  |  | 72 hours | 0 | 0 | 0 |
| EPO | 0.05 | Pre-bleed | 0 | 0 | 0 |
|  |  | 8 hours | 19,858 | 7,072 | 13,465 |
|  |  | 24 hours | 18,178 | 4,913 | 11,546 |
|  |  | 48 hours | 5,291 | 498 | 2,895 |
|  |  | 72 hours | 744 | 60 | 402 |
| EPO | 0.005 | Pre-bleed | 0 | 0 | 0 |
|  |  | 8 hours | 523 | 250 | 387 |
|  |  | 24 hours | 302 | 113 | 208 |
|  |  | 48 hours | <7.8 | <7.8 | <7.8 |
|  |  | 72 hours | 0 | 0 | 0 |

Example 23

Non-Human Primate In Vivo Study for G-CSF and EPO

LNP formulations, shown in Table 37 (above), were administered to non-human primates (NHP) (cynomolgus monkey) (n=2) as intravenous injection (IV). The NHP were administered a single modified mRNA IV dose of 0.5 mg/kg, 0.05 mg/kg or 0.005 mg/kg of G-CSF or EPO in a dose volume of 0.5 mL/kg. The NHPs were bled before dosing with the modified mRNA LNP formulations to determine protein expression in the serum and a baseline complete blood count. After administration with the G-CSF modified mRNA formulation the NHP were bled at 8, 24, 48 and 72 hours to determined protein expression. After administration with the EPO modified mRNA formulation the NHP were bled at 8, 24, 48, 72 hours and 7 days to determined protein expression.

Samples collected from the NHPs after they were administered with G-CSF or EPO modified mRNA formulations were analyzed by ELISA to determine protein expression. Neutrophil and reticulocyte count was also determined pre-dose, 24 hours, 3 days, 7 days, 14 days and 18 days after administration of the modified G-CSF or EPO formulation.

As shown in Table 42, G-CSF protein expression was not detected beyond 72 hours. In Table 42, "<39" refers to a value below the lower limit of detection of 39 pg/ml.

TABLE 42

G-CSF Protein Expression

| Modified mRNA | Dose (mg/kg) | Time | Female NHP Serum G-CSF Concentration (pg/ml) | Male NHP Serum G-CSF Concentration (pg/ml) |
|---|---|---|---|---|
| G-CSF | 0.5 | Pre-bleed | <39 | <39 |
| | | 8 hours | 43,525 | 43,594 |
| | | 24 hours | 11,374 | 3,628 |
| | | 48 hours | 1,100 | 833 |
| | | 72 hours | <39 | 306 |
| G-CSF | 0.05 | Pre-bleed | <39 | <39 |
| | | 8 hours | 3,289 | 1,722 |
| | | 24 hours | 722 | 307 |
| | | 48 hours | <39 | <39 |
| | | 72 hours | <39 | <39 |
| G-CSF | 0.005 | Pre-bleed | <39 | <39 |
| | | 8 hours | 559 | 700 |
| | | 24 hours | 155 | <39 |
| | | 48 hours | <39 | <39 |
| | | 72 hours | <39 | <39 |

As shown in Table 43, EPO protein expression was not detected beyond 7 days. In Table 43, "<7.8" refers to a value below the lower limit of detection of 7.8 pg/ml.

TABLE 43

EPO Protein Expression

| Modified mRNA | Dose (mg/kg) | Time | Female NHP Serum EPO Concentration (pg/ml) | Male NHP Serum EPO Concentration (pg/ml) |
|---|---|---|---|---|
| EPO | 0.5 | Pre-bleed | <7.8 | <7.8 |
| | | 8 hours | 158,771 | 119,086 |
| | | 24 hours | 133,978 | 85,825 |
| | | 48 hours | 45,250 | 64,793 |
| | | 72 hours | 15,097 | 20,407 |
| | | 7 days | <7.8 | <7.8 |
| EPO | 0.05 | Pre-bleed | <7.8 | <7.8 |
| | | 8 hours | 19,858 | 7,072 |
| | | 24 hours | 18,187 | 4,913 |
| | | 48 hours | 5,291 | 498 |
| | | 72 hours | 744 | 60 |
| | | 7 days | <7.8 | <7.8 |
| EPO | 0.005 | Pre-bleed | <7.8 | <7.8 |
| | | 8 hours | 523 | 250 |
| | | 24 hours | 302 | 113 |
| | | 48 hours | 11 | 29 |
| | | 72 hours | <7.8 | <7.8 |
| | | 7 days | <7.8 | <7.8 |

As shown in Table 44, there was an increase in neutrophils in all G-CSF groups relative to pre-dose levels.

TABLE 44

Pharmacologic Effect of G-CSF mRNA in NHP

| Dose (mg/kg) | Time | Male NHP (G-CSF) Neutrophils ($10^9$/L) | Female NHP (G-CSF) Neutrophils ($10^9$/L) | Male NHP (EPO) Neutrophils ($10^9$/L) | Female NHP (EPO) Neutrophils ($10^9$/L) |
|---|---|---|---|---|---|
| 0.5 | Pre-dose | 1.53 | 1.27 | 9.72 | 1.82 |
| | 24 hours | 14.92 | 13.96 | 7.5 | 11.85 |
| | 3 days | 9.76 | 13.7 | 11.07 | 5.22 |
| | 7 days | 2.74 | 3.81 | 11.8 | 2.85 |
| | 14/18 days | 2.58 | 1.98 | 7.16 | 2.36 |
| 0.05 | Pre-dose | 13.74 | 3.05 | 0.97 | 2.15 |
| | 24 hours | 19.92 | 29.91 | 2.51 | 2.63 |
| | 3 days | 7.49 | 10.77 | 1.73 | 4.08 |
| | 7 days | 4.13 | 3.8 | 1.23 | 2.77 |
| | 14/18 days | 3.59 | 1.82 | 1.53 | 1.27 |
| 0.005 | Pre-dose | 1.52 | 2.54 | 5.46 | 5.96 |
| | 24 hours | 16.44 | 8.6 | 5.37 | 2.59 |
| | 3 days | 3.74 | 1.78 | 6.08 | 2.83 |
| | 7 days | 7.28 | 2.27 | 3.51 | 2.23 |
| | 14/18 days | 4.31 | 2.28 | 1.52 | 2.54 |

As shown in Table 45, there was an increase in reticulocytes in all EPO groups 3 days to 14/18 days after dosing relative to reticulocyte levels 24 hours after dosing.

TABLE 45

Pharmacologic Effect of EPO mRNA on Neutrophil Count

| Dose (mg/kg) | Time | Male NHP (G-CSF) Neutrophils ($10^{12}$/L) | Female NHP (G-CSF) Neutrophils ($10^{12}$/L) | Male NHP (EPO) Neutrophils ($10^{12}$/L) | Female NHP (EPO) Neutrophils ($10^{12}$/L) |
|---|---|---|---|---|---|
| 0.5 | Pre-dose | 0.067 | 0.055 | 0.107 | 0.06 |
|  | 24 hours | 0.032 | 0.046 | 0.049 | 0.045 |
|  | 3 days | 0.041 | 0.017 | 0.09 | 0.064 |
|  | 7 days | 0.009 | 0.021 | 0.35 | 0.367 |
|  | 14/18 days | 0.029 | 0.071 | 0.066 | 0.071 |
| 0.05 | Pre-dose | 0.055 | 0.049 | 0.054 | 0.032 |
|  | 24 hours | 0.048 | 0.046 | 0.071 | 0.04 |
|  | 3 days | 0.101 | 0.061 | 0.102 | 0.105 |
|  | 7 days | 0.157 | 0.094 | 0.15 | 0.241 |
|  | 14/18 days | 0.107 | 0.06 | 0.067 | 0.055 |
| 0.005 | Pre-dose | 0.037 | 0.06 | 0.036 | 0.052 |
|  | 24 hours | 0.037 | 0.07 | 0.034 | 0.061 |
|  | 3 days | 0.037 | 0.054 | 0.079 | 0.118 |
|  | 7 days | 0.046 | 0.066 | 0.049 | 0.087 |
|  | 14/18 days | 0.069 | 0.057 | 0.037 | 0.06 |

As shown in Tables 46-48, the administration of EPO modified RNA had an effect on other erythropoetic parameters including hemoglobin (HGB), hematocrit (HCT) and red blood cell (RBC) count.

TABLE 46

Pharmacologic Effect of EPO mRNA on Hemoglobin

| Dose (mg/kg) | Time | Male NHP (G-CSF) HGB (g/L) | Female NHP (G-CSF) HGB (g/L) | Male NHP (EPO) HGB (g/L) | Female NHP (EPO) HGB (g/L) |
|---|---|---|---|---|---|
| 0.5 | Pre-dose | 133 | 129 | 134 | 123 |
|  | 24 hours | 113 | 112 | 127 | 108 |
|  | 3 days | 118 | 114 | 126 | 120 |
|  | 7 days | 115 | 116 | 140 | 134 |
|  | 14/18 days | 98 | 113 | 146 | 133 |
| 0.05 | Pre-dose | 137 | 129 | 133 | 133 |
|  | 24 hours | 122 | 117 | 123 | 116 |
|  | 3 days | 126 | 115 | 116 | 120 |
|  | 7 days | 126 | 116 | 126 | 121 |
|  | 14/18 days | 134 | 123 | 133 | 129 |
| 0.005 | Pre-dose | 128 | 129 | 132 | 136 |
|  | 24 hours | 117 | 127 | 122 | 128 |
|  | 3 days | 116 | 127 | 125 | 130 |
|  | 7 days | 116 | 129 | 119 | 127 |
|  | 14/18 days | 118 | 129 | 128 | 129 |

TABLE 47

Pharmacologic Effect of EPO mRNA on Hematocrit

| Dose (mg/kg) | Time | Male NHP (G-CSF) HCT (L/L) | Female NHP (G-CSF) HCT (L/L) | Male NHP (EPO) HCT (L/L) | Female NHP (EPO) HCT (L/L) |
|---|---|---|---|---|---|
| 0.5 | Pre-dose | 0.46 | 0.43 | 0.44 | 0.4 |
|  | 24 hours | 0.37 | 0.38 | 0.4 | 0.36 |
|  | 3 days | 0.39 | 0.38 | 0.41 | 0.39 |
|  | 7 days | 0.39 | 0.38 | 0.45 | 0.45 |
|  | 14/18 days | 0.34 | 0.37 | 0.48 | 0.46 |
| 0.05 | Pre-dose | 0.44 | 0.44 | 0.45 | 0.43 |
|  | 24 hours | 0.39 | 0.4 | 0.43 | 0.39 |
|  | 3 days | 0.41 | 0.39 | 0.38 | 0.4 |
|  | 7 days | 0.42 | 0.4 | 0.45 | 0.41 |
|  | 14/18 days | 0.44 | 0.4 | 0.46 | 0.43 |

TABLE 47-continued

Pharmacologic Effect of EPO mRNA on Hematocrit

| Dose (mg/kg) | Time | Male NHP (G-CSF) HCT (L/L) | Female NHP (G-CSF) HCT (L/L) | Male NHP (EPO) HCT (L/L) | Female NHP (EPO) HCT (L/L) |
|---|---|---|---|---|---|
| 0.005 | Pre-dose | 0.42 | 0.42 | 0.48 | 0.45 |
|  | 24 hours | 0.4 | 0.42 | 0.42 | 0.43 |
|  | 3 days | 0.4 | 0.41 | 0.44 | 0.42 |
|  | 7 days | 0.39 | 0.42 | 0.41 | 0.42 |
|  | 14/18 days | 0.41 | 0.42 | 0.42 | 0.42 |

TABLE 48

Pharmacologic Effect of EPO mRNA on Red Blood Cells

| Dose (mg/kg) | Time | Male NHP (G-CSF) RBC ($10^{12}$/L) | Female NHP (G-CSF) RBC ($10^{12}$/L) | Male NHP (EPO) RBC ($10^{12}$/L) | Female NHP (EPO) RBC ($10^{12}$/L) |
|---|---|---|---|---|---|
| 0.5 | Pre-dose | 5.57 | 5.57 | 5.43 | 5.26 |
|  | 24 hours | 4.66 | 4.96 | 5.12 | 4.69 |
|  | 3 days | 4.91 | 4.97 | 5.13 | 5.15 |
|  | 7 days | 4.8 | 5.04 | 5.55 | 5.68 |
|  | 14/18 days | 4.21 | 4.92 | 5.83 | 5.72 |
| 0.05 | Pre-dose | 5.68 | 5.64 | 5.57 | 5.84 |
|  | 24 hours | 4.96 | 5.08 | 5.25 | 5.18 |
|  | 3 days | 5.13 | 5.04 | 4.81 | 5.16 |
|  | 7 days | 5.17 | 5.05 | 5.37 | 5.31 |
|  | 14/18 days | 5.43 | 5.26 | 5.57 | 5.57 |
| 0.005 | Pre-dose | 5.67 | 5.36 | 6.15 | 5.72 |
|  | 24 hours | 5.34 | 5.35 | 5.63 | 5.35 |
|  | 3 days | 5.32 | 5.24 | 5.77 | 5.42 |
|  | 7 days | 5.25 | 5.34 | 5.49 | 5.35 |
|  | 14/18 days | 5.37 | 5.34 | 5.67 | 5.36 |

As shown in Tables 49 and 50, the administration of modified RNA had an effect on serum chemistry parameters including alanine transaminase (ALT) and aspartate transaminase (AST).

TABLE 49

Pharmacologic Effect of EPO mRNA on Alanine Transaminase

| Dose (mg/kg) | Time | Male NHP (G-CSF) ALT (U/L) | Female NHP (G-CSF) ALT (U/L) | Male NHP (EPO) ALT (U/L) | Female NHP (EPO) ALT (U/L) |
|---|---|---|---|---|---|
| 0.5 | Pre-dose | 29 | 216 | 50 | 31 |
|  | 2 days | 63 | 209 | 98 | 77 |
|  | 4 days | 70 | 98 | 94 | 87 |
|  | 7 days | 41 | 149 | 60 | 59 |
|  | 14 days | 43 | 145 | 88 | 44 |
| 0.05 | Pre-dose | 58 | 53 | 56 | 160 |
|  | 2 days | 82 | 39 | 95 | 254 |
|  | 4 days | 88 | 56 | 70 | 200 |
|  | 7 days | 73 | 73 | 64 | 187 |
|  | 14 days | 50 | 31 | 29 | 216 |
| 0.005 | Pre-dose | 43 | 51 | 45 | 45 |
|  | 2 days | 39 | 32 | 62 | 48 |
|  | 4 days | 48 | 58 | 48 | 50 |
|  | 7 days | 29 | 55 | 21 | 48 |
|  | 14 days | 44 | 46 | 43 | 51 |

TABLE 50

Pharmacologic Effect of EPO mRNA on Aspartate Transaminase

| Dose (mg/kg) | Time | Male NHP (G-CSF) AST (U/L) | Female NHP (G-CSF) AST (U/L) | Male NHP (EPO) AST (U/L) | Female NHP (EPO) AST (U/L) |
|---|---|---|---|---|---|
| 0.5 | Pre-dose | 32 | 47 | 59 | 20 |
|  | 2 days | 196 | 294 | 125 | 141 |
|  | 4 days | 67 | 63 | 71 | 60 |
|  | 7 days | 53 | 68 | 56 | 47 |
|  | 14 days | 47 | 67 | 82 | 44 |

TABLE 50-continued

Pharmacologic Effect of EPO mRNA on Aspartate Transaminase

| Dose (mg/kg) | Time | Male NHP (G-CSF) AST (U/L) | Female NHP (G-CSF) AST (U/L) | Male NHP (EPO) AST (U/L) | Female NHP (EPO) AST (U/L) |
|---|---|---|---|---|---|
| 0.05 | Pre-dose | 99 | 33 | 74 | 58 |
| | 2 days | 95 | 34 | 61 | 80 |
| | 4 days | 69 | 42 | 48 | 94 |
| | 7 days | 62 | 52 | 53 | 78 |
| | 14 days | 59 | 20 | 32 | 47 |
| 0.005 | Pre-dose | 35 | 54 | 39 | 40 |
| | 2 days | 70 | 34 | 29 | 25 |
| | 4 days | 39 | 36 | 43 | 55 |
| | 7 days | 28 | 31 | 55 | 31 |
| | 14 days | 39 | 20 | 35 | 54 |

As shown in Table 51, the administration of lipid nanoparticle-formulated modified RNA at high doses (0.5 mg/kg) caused an increase in cytokines, interferon-alpha (IFN-alpha) after administration of modified mRNA.

TABLE 51

Pharmacologic Effect of EPO mRNA on Alanine Transaminase

| Dose (mg/kg) | Time | Male NHP (G-CSF) IFN-alpha (pg/mL) | Female NHP (G-CSF) IFN-alpha (pg/mL) | Male NHP (EPO) IFN-alpha (pg/mL) | Female NHP (EPO) IFN-alpha (pg/mL) |
|---|---|---|---|---|---|
| 0.5 | Pre-dose | 0 | 0 | 0 | 0 |
| | Day 1 + 8 hr | 503.8 | 529.2 | 16.79 | 217.5 |
| | 4 days | 0 | 0 | 0 | 0 |
| 0.05 | Pre-dose | 0 | 0 | 0 | 0 |
| | Day 1 + 8 hr | 0 | 0 | 0 | 0 |
| | 4 days | 0 | 0 | 0 | 0 |
| 0.005 | Pre-dose | 0 | 0 | 0 | 0 |
| | Day 1 + 8 hr | 0 | 0 | 0 | 0 |
| | 4 days | 0 | 0 | 0 | 0 |

Example 24

Study of Intramuscular and/or Subcutaneous Administration in Non-Human Primates

Formulations containing modified EPO mRNA (mRNA sequence shown in SEQ ID NO: 33900; polyA tail of approximately 160 nucleotides not shown in sequence; 5'cap, Cap1; fully modified with 5-methylcytosine and pseudouridine) or G-CSF mRNA (mRNA sequence shown in SEQ ID NO: 33897; polyA tail of approximately 160 nucleotides not shown in sequence; 5'cap, Cap1; fully modified with 5-methylcytosine and pseudouridine) in saline were administered to non-human primates (Cynomolgus monkey) (NHP) intramuscularly (IM) or subcutaneously (SC). The single modified mRNA dose of 0.05 mg/kg or 0.005 mg/kg was in a dose volume of 0.5 mL/kg. The non-human primates are bled 5-6 days prior to dosing to determine serum protein concentration and a baseline complete blood count. After administration with the modified mRNA formulation the NHP are bled at 8 hours, 24 hours, 48 hours, 72 hours, 7 days and 14 days to determined protein expression. Protein expression of G-CSF and EPO is determined by ELISA. At 24 hours, 72 hours, 7 days and 14 days after administration the complete blood count of the NHP is also determined. Urine from the NHPs is collected over the course of the entire experiment and analyzed to evaluate clinical safety. Tissue near the injection site is also collected and analyzed to determine protein expression.

Example 25

Modified mRNA Trafficking

In order to determine localization and/or trafficking of the modified mRNA, studies may be performed as follows.

LNP formulations of siRNA and modified mRNA are formulated according to methods known in the art and/or described herein. The LNP formulations may include at least one modified mRNA which may encode a protein such as G-CSF, EPO, Factor VII, and/or any protein described herein. The formulations may be administered locally into muscle of mammals using intramuscular or subcutaneous injection. The dose of modified mRNA and the size of the LNP may be varied to determine the effect on trafficking in the body of the mammal and/or to assess the impact on a biologic reaction such as, but not limited to, inflammation. The mammal may be bled at different time points to determine the expression of protein encoded by the modified mRNA administered present in the serum and/or to determine the complete blood count in the mammal.

For example, modified mRNA encoding Factor VII, expressed in the liver and secreted into the serum, may be administered intramuscularly and/or subcutaneously. Coincident or prior to modified mRNA administration, siRNA is administered to knock out endogenous Factor VII. Factor VII arising from the intramuscular and/or subcutaneous injection of modified mRNA is administered is measured in the blood. Also, the levels of Factor VII is measured in the tissues near the injection site. If Factor VII is expressed in blood then there is trafficking of the modified mRNA. If Factor VII is expressed in tissue and not in the blood than there is only local expression of Factor VII.

Example 26

Formulations of Multiple Modified mRNA

LNP formulations of modified mRNA are formulated according to methods known in the art and/or described herein or known in the art. The LNP formulations may include at least one modified mRNA which may encode a protein such as G-CSF, EPO, thrombopoietin and/or any protein described herein. The at least one modified mRNA may include 1, 2, 3, 4 or 5 modified mRNA molecules. The formulations containing at least one modified mRNA may be administered intravenously, intramuscularly or subcutaneously in a single or multiple dosing regimens. Biological samples such as, but not limited to, blood and/or serum may be collected and analyzed at different time points before and/or after administration of the at least one modified mRNA formulation. An expression of a protein in a biological sample of 50-200 pg/ml after the mammal has been administered a formulation containing at least one modified mRNA encoding said protein would be considered biologically effective.

Example 27

Polyethylene Glycol Ratio Studies

A. Formulation and Characterization of PEG LNPs

Lipid nanoparticles (LNPs) were formulated using the syringe pump method. The LNPs were formulated at a 20:1 weight ratio of total lipid to modified G-CSF mRNA (mRNA sequence shown in SEQ ID NO: 33897; polyA tail of approximately 160 nucleotides not shown in sequence; 5'cap, Cap1; fully modified with 5-methylcytosine and pseudouridine). The molar ratio ranges of the formulations are shown in Table 52.

TABLE 52

Molar Ratios

| | DLin-KC2-DMA | DSPC | Cholesterol | PEG-c-DOMG |
|---|---|---|---|---|
| Mole Percent (mol %) | 50.0 | 10.0 | 37-38.5 | 1.5-3 |

Two types of PEG lipid, 1,2-Dimyristoyl-sn-glycerol, methoxypolyethylene Glycol (PEG-DMG, NOF Cat #SUNBRIGHT® GM-020) and 1,2-Distearoyl-sn-glycerol, methoxypolyethylene Glycol (PEG-DSG, NOF Cat #SUNBRIGHT® GS-020), were tested at 1.5 or 3.0 mol %. After the formation of the LNPs and the encapsulation of the modified G-CSF mRNA, the LNP formulations were characterized by particle size, zeta potential and encapsulation percentage and the results are shown in Table 53.

TABLE 53

Characterization of LNP Formulations

| | Formulation No. | | | |
|---|---|---|---|---|
| | NPA-071-1 | NPA-072-1 | NPA-073-1 | NPA-074-1 |
| Lipid | PEG-DMG 1.5% | PEG-DMG 3% | PEG-DSA 1.5% | PEG-DSA 3% |

TABLE 53-continued

Characterization of LNP Formulations

| | Formulation No. | | | |
|---|---|---|---|---|
| | NPA-071-1 | NPA-072-1 | NPA-073-1 | NPA-074-1 |
| Mean Size | 95 nm PDI: 0.01 | 85 nm PDI: 0.06 | 95 nm PDI: 0.08 | 75 nm PDI: 0.08 |
| Zeta at pH 7.4 | −1.1 mV | −2.6 mV | 1.7 mV | 0.7 mV |
| Encapsulation (RiboGreen) | 88% | 89% | 98% | 95% |

B. In Vivo Screening of PEG LNPs

Formulations of the PEG LNPs described in Table 54 were administered to mice (n=5) intravenously at a dose of 0.5 mg/kg. Serum was collected from the mice at 2 hours, 8 hours, 24 hours, 48 hours, 72 hours and 8 days after administration of the formulation. The serum was analyzed by ELISA to determine the protein expression of G-CSF and the expression levels are shown in Table 54. LNP formulations using PEG-DMG gave substantially higher levels of protein expression than LNP formulations with PEG-DSA.

TABLE 54

Protein Expression

| Lipid | Formulation No. | Time | Protein Expression (pg/ml) |
|---|---|---|---|
| PEG-DMG, 1.5% | NPA-071-1 | 2 hours | 114,102 |
| | | 8 hours | 357,944 |
| | | 24 hours | 104,832 |
| | | 48 hours | 6,697 |
| | | 72 hours | 980 |
| | | 8 days | 0 |
| PEG-DMG, 3% | NPA-072-1 | 2 hours | 154,079 |
| | | 8 hours | 354,994 |
| | | 24 hours | 164,311 |
| | | 48 hours | 13,048 |
| | | 72 hours | 1,182 |
| | | 8 days | 13 |
| PEG-DSA, 1.5% | NPA-073-1 | 2 hours | 3,193 |
| | | 8 hours | 6,162 |
| | | 24 hours | 446 |
| | | 48 hours | 197 |
| | | 72 hours | 124 |
| | | 8 days | 5 |
| PEG-DSA, 3% | NPA-074-1 | 2 hours | 259 |
| | | 8 hours | 567 |
| | | 24 hours | 258 |
| | | 48 hours | 160 |
| | | 72 hours | 328 |
| | | 8 days | 33 |

Example 28

Cationic Lipid Formulation Studies

A. Formulation and Characterization of Cationic Lipid Nanoparticles

Lipid nanoparticles (LNPs) were formulated using the syringe pump method. The LNPs were formulated at a 20:1 weight ratio of total lipid to modified mRNA. The final lipid molar ratio ranges of cationic lipid, DSPC, cholesterol and PEG-c-DOMG are outlined in Table 55.

TABLE 55

| Molar Ratios | | | | |
| --- | --- | --- | --- | --- |
| | Cationic Lipid | DSPC | Cholesterol | PEG-c-DOMG |
| Mole Percent (mol %) | 50.0 | 10.0 | 38.5 | 1.5 |

A 25 mM lipid solution in ethanol and modified RNA in 50 mM citrate at a pH of 3 were mixed to create spontaneous vesicle formation. The vesicles were stabilized in ethanol before the ethanol was removed and there was a buffer exchange by dialysis. The LNPs were then characterized by particle size, zeta potential, and encapsulation percentage. Table 56 describes the characterization of LNPs encapsulating EPO modified mRNA (mRNA sequence shown in SEQ ID NO: 33900 polyA tail of approximately 160 nucleotides not shown in sequence; 5'cap, Cap1; fully modified with 5-methylcytosine and pseudouridine) or G-CSF modified mRNA (mRNA sequence shown in SEQ ID NO: 33897; polyA tail of approximately 160 nucleotides not shown in sequence; 5'cap, Cap1; fully modified with 5-methylcytosine and pseudouridine) using DLin-MC3-DMA, DLin-DMA or C12-200 as the cationic lipid.

TABLE 56

| Characterization of Cationic Lipid Formulations | | | | | | |
| --- | --- | --- | --- | --- | --- | --- |
| | Formulation No. | | | | | |
| | NPA-071-1 | NPA-072-1 | NPA-073-1 | NPA-074-1 | NPA-075-1 | NPA-076-1 |
| Lipid | DLin-MC3-DMA | DLin-MC3-DMA | DLin-DMA | DLin-DMA | C12-200 | C12-200 |
| Modified RNA | EPO | G-CSF | EPO | G-CSF | EPO | G-CSF |
| Mean Size | 89 nm PDI: 0.07 | 96 nm PDI: 0.08 | 70 nm PDI: 0.04 | 73 nm PDI: 0.06 | 97 nm PDI: 0.05 | 103 nm PDI: 0.09 |
| Zeta at pH 7.4 | −1.1 mV | −1.4 mV | −1.6 mV | −0.4 mV | 1.4 mV | 0.9 mV |
| Encapsulation (RiboGreen) | 100% | 100% | 99% | 100% | 88% | 98% |

B. In Vivo Screening of Cationic LNP Formulations

Formulations of the cationic lipid formulations described in Table 56 were administered to mice (n=5) intravenously at a dose of 0.5 mg/kg. Serum was collected from the mice at 2 hours, 24 hours, 72 hours and/or 7 days after administration of the formulation. The serum was analyzed by ELISA to determine the protein expression of EPO or G-CSF and the expression levels are shown in Table 57.

TABLE 57

| Protein Expression | | | |
| --- | --- | --- | --- |
| Modified mRNA | Formulation No. | Time | Protein Expression (pg/ml) |
| EPO | NPA-071-1 | 2 hours | 304,190.0 |
| | | 24 hours | 166,811.5 |
| | | 72 hours | 1,356.1 |
| | | 7 days | 20.3 |
| EPO | NPA-073-1 | 2 hours | 73,852.0 |
| | | 24 hours | 75,559.7 |
| | | 72 hours | 130.8 |

TABLE 57-continued

| Protein Expression | | | |
| --- | --- | --- | --- |
| Modified mRNA | Formulation No. | Time | Protein Expression (pg/ml) |
| EPO | NPA-075-1 | 2 hours | 413,010.2 |
| | | 24 hours | 56,463.8 |
| G-CSF | NPA-072-1 | 2 hours | 62,113.1 |
| | | 24 hours | 53,206.6 |
| G-CSF | NPA-074-1 | 24 hours | 25,059.3 |
| G-CSF | NPA-076-1 | 2 hours | 219,198.1 |
| | | 24 hours | 8,470.0 |

Toxicity was seen in the mice administered the LNPs formulations with the cationic lipid C12-200 (NPA-075-1 and NPA-076-1) and they were sacrificed at 24 hours because they showed symptoms such as scrubby fur, cowering behavior and weight loss of greater than 10%. C12-200 was expected to be more toxic but also had a high level of expression over a short period. The cationic lipid DLin-DMA (NPA-073-1 and NPA-074-1) had the lowest expression out of the three cationic lipids tested. DLin-MC3-DMA (NPA-071-1 and NPA-072-1) showed good expression up to day three and was above the background sample out to day 7 for EPO formulations.

Example 29

Method of Screening for Protein Expression

A. Electrospray Ionization

A biological sample which may contain proteins encoded by modified RNA administered to the subject is prepared and analyzed according to the manufacturer protocol for electrospray ionization (ESI) using 1, 2, 3 or 4 mass analyzers. A biologic sample may also be analyzed using a tandem ESI mass spectrometry system.

Patterns of protein fragments, or whole proteins, are compared to known controls for a given protein and identity is determined by comparison.

B. Matrix-Assisted Laser Desorption/Ionization

A biological sample which may contain proteins encoded by modified RNA administered to the subject is prepared and analyzed according to the manufacturer protocol for matrix-assisted laser desorption/ionization (MALDI).

Patterns of protein fragments, or whole proteins, are compared to known controls for a given protein and identity is determined by comparison.

C. Liquid Chromatography-Mass Spectrometry-Mass Spectrometry

A biological sample, which may contain proteins encoded by modified RNA, may be treated with a trypsin enzyme to digest the proteins contained within. The resulting peptides are analyzed by liquid chromatography-mass spectrometry-mass spectrometry (LC/MS/MS). The peptides are fragmented in the mass spectrometer to yield diagnostic patterns that can be matched to protein sequence databases via computer algorithms. The digested sample may be diluted to achieve 1 ng or less starting material for a given protein. Biological samples containing a simple buffer background (e.g. water or volatile salts) are amenable to direct in-solution digest; more complex backgrounds (e.g. detergent, non-volatile salts, glycerol) require an additional clean-up step to facilitate the sample analysis.

Patterns of protein fragments, or whole proteins, are compared to known controls for a given protein and identity is determined by comparison.

Example 30

Lipid Nanoparticle In Vivo Studies mCherry mRNA (mRNA sequence shown in SEQ ID NO: 33905; polyA tail of approximately 160 nucleotides not shown in sequence; 5'cap, Cap1; fully modified with 5-methylcytosine and pseudouridine) was formulated as a lipid nanoparticle (LNP) using the syringe pump method. The LNP was formulated at a 20:1 weight ratio of total lipid to modified mRNA with a final lipid molar ratio of 50:10:38.5:1.5 (DLin-KC2-DMA: DSPC: Cholesterol: PEG-c-DOMG). The mCherry formulation, listed in Table 58, was characterized by particle size, zeta potential, and encapsulation.

TABLE 58 mCherry Formulation

| Formulation # | NPA-003-5 |
|---|---|
| Modified mRNA | mCherry |
| Mean size | 105 nm |
| | PDI: 0.09 |
| Zeta at pH 7.4 | 1.8 mV |
| Encaps. (RiboGr) | 100% |

The LNP formulation was administered to mice (n=5) intravenously at a modified mRNA dose of 100 ug. Mice were sacrificed at 24 hrs after dosing. The liver and spleen from the mice administered with mCherry modified mRNA formulations were analyzed by immunohistochemistry (IHC), western blot, or fluorescence-activated cell sorting (FACS).

Histology of the liver showed uniform mCherry expression throughout the section, while untreated animals did not express mCherry. Western blots were also used to confirm mCherry expression in the treated animals, whereas mCherry was not detected in the untreated animals. Tubulin was used as a control marker and was detected in both treated and untreated mice, indicating that normal protein expression in hepatocytes was unaffected.

FACS and IHC were also performed on the spleens of mCherry and untreated mice. All leukocyte cell populations were negative for mCherry expression by FACS analysis. By IHC, there were also no observable differences in the spleen in the spleen between mCherry treated and untreated mice.

Example 31

Syringe Pump In Vivo Studies mCherry modified mRNA (mRNA sequence shown in SEQ ID NO: 33898; polyA tail of approximately 160 nucleotides not shown in sequence; 5'cap, Cap1) is formulated as a lipid nanoparticle (LNP) using the syringe pump method. The LNP is formulated at a 20:1 weight ratio of total lipid to modified mRNA with a final lipid molar ratio of 50:10:38.5:1.5 (DLin-KC2-DMA: DSPC: Cholesterol: PEG-c-DOMG). The mCherry formulation is characterized by particle size, zeta potential, and encapsulation.

The LNP formulation is administered to mice (n=5) intravenously at a modified mRNA dose of 10 or 100 ug. Mice are sacrificed at 24 hrs after dosing. The liver and spleen from the mice administered with mCherry modified mRNA formulations are analyzed by immunohistochemistry (IHC), western blot, and/or fluorescence-activated cell sorting (FACS).

Example 32

In Vitro and In Vivo Expression

A. In Vitro Expression in Human Cells Using Lipidoid Formulations

The ratio of mmRNA to lipidoid used to test for in vitro transfection is tested empirically at different lipidoid: mmRNA ratios. Previous work using siRNA and lipidoids have utilized 2.5:1, 5:1, 10:1, and 15:1 lipidoid:siRNA wt:wt ratios. Given the longer length of mmRNA relative to siRNA, a lower wt:wt ratio of lipidoid to mmRNA may be effective. In addition, for comparison mmRNA were also formulated using RNAIMAX™ (Invitrogen, Carlsbad, Calif.) or TRANSIT-mRNA (Mirus Bio, Madison, Wis.) cationic lipid delivery vehicles.

The ability of lipidoid-formulated Luciferase (IVT cDNA sequence as shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site), green fluorescent protein (GFP) (IVT cDNA sequence as shown in SEQ ID NO: 3308; mRNA sequence shown in SEQ ID NO: 33909, polyA tail of approximately 160 nucleotides not shown in sequence, 5'cap, Cap1, fully modified with 5-methylcytosine at each cytosine and pseudouridine replacement at each uridine site), G-CSF mRNA (mRNA sequence shown in SEQ ID NO: 33898; polyA tail of approximately 160 nucleotides not shown in sequence; 5'cap, Cap1), and EPO mRNA (mRNA sequence shown in SEQ ID NO: 33900; polyA tail of approximately 160 nucleotides not shown in sequence; 5'cap, Cap1) to express the desired protein product can be confirmed by luminescence for luciferase expression, flow cytometry for GFP expression, and by ELISA for G-CSF and Erythropoietin (EPO) secretion.

B. In Vivo Expression Following Intravenous Injection

Systemic intravenous administration of the formulations are created using various different lipidoids including, but not limited to, 98N12-5, C12-200, and MD1.

Lipidoid formulations containing mmRNA are injected intravenously into animals. The expression of the modified mRNA (mmRNA)-encoded proteins are assessed in blood and/or other organs samples such as, but not limited to, the liver and spleen collected from the animal. Conducting single dose intravenous studies will also allow an assessment of the magnitude, dose responsiveness, and longevity of expression of the desired product.

In one embodiment, lipidoid based formulations of 98N12-5, C12-200, MD1 and other lipidoids, are used to deliver luciferase, green fluorescent protein (GFP), mCherry fluorescent protein, secreted alkaline phosphatase (sAP), human G-CSF, human Factor IX, or human Erythropoietin (EPO) mmRNA into the animal. After formulating mmRNA with a lipid, as described previously, animals are divided into groups to receive either a saline formulation, or a lipidoid-formulation which contains one of a different mmRNA selected from luciferase, GFP, mCherry, sAP, human G-CSF, human Factor IX, and human EPO. Prior to injection into the animal, mmRNA-containing lipidoid formulations are diluted in PBS. Animals are then administered a single dose of formulated mmRNA ranging from a dose of 10 mg/kg to doses as low as 1 ng/kg, with a preferred range to be 10 mg/kg to 100 ng/kg, where the dose of mmRNA depends on the animal body weight such as a 20 gram mouse receiving a maximum formulation of 0.2 ml (dosing is based no mmRNA per kg body weight). After the administration of the mmRNA-lipidoid formulation, serum, tissues, and/or tissue lysates are obtained and the level of the mmRNA-encoded product is determined at a single and/or a range of time intervals. The ability of lipidoid-formulated Luciferase, GFP, mCherry, sAP, G-CSF, Factor IX, and EPO mmRNA to express the desired protein product is confirmed by luminescence for the expression of Luciferase, flow cytometry for the expression of GFP and mCherry expression, by enzymatic activity for sAP, or by ELISA for the section of G-CSF, Factor IX and/or EPO.

Further studies for a multi-dose regimen are also performed to determine the maximal expression of mmRNA, to evaluate the saturability of the mmRNA-driven expression (by giving a control and active mmRNA formulation in parallel or in sequence), and to determine the feasibility of repeat drug administration (by giving mmRNA in doses separated by weeks or months and then determining whether expression level is affected by factors such as immunogenicity). An assessment of the physiological function of proteins such as G-CSF and EPO are also determined through analyzing samples from the animal tested and detecting increases in granulocyte and red blood cell counts, respectively. Activity of an expressed protein product such as Factor IX, in animals can also be assessed through analysis of Factor IX enzymatic activity (such as an activated partial thromboplastin time assay) and effect of clotting times.

C. In Vitro Expression Following Intramuscular and/or Subcutaneous Injection

The use of lipidoid formulations to deliver oligonucleotides, including mRNA, via an intramuscular route or a subcutaneous route of injection needs to be evaluated as it has not been previously reported. Intramuscular and/or subcutaneous injection of mmRNA are evaluated to determine if mmRNA-containing lipidoid formulations are capable to produce both localized and systemic expression of a desired proteins.

Lipidoid formulations of 98N12-5, C, 12-200, and MDl-containing mmRNA selected from luciferase, green fluorescent protein (GFP), mCherry fluorescent protein, secreted alkaline phosphatase (sAP), human G-CSF, human factor IX, or human Erythropoietin (EPO) mmRNA are injected intramuscularly and/or subcutaneously into animals. The expression of mmRNA-encoded proteins are assessed both within the muscle or subcutaneous tissue and systemically in blood and other organs such as the liver and spleen. Single dose studies allow an assessment of the magnitude, dose responsiveness, and longevity of expression of the desired product.

Animals are divided into groups to receive either a saline formulation or a formulation containing modified mRNA. Prior to injection mmRNA-containing lipidoid formulations are diluted in PBS. Animals are administered a single intramuscular dose of formulated mmRNA ranging from 50 mg/kg to doses as low as 1 ng/kg with a preferred range to be 10 mg/kg to 100 ng/kg. A maximum dose for intramuscular administration, for a mouse, is roughly 1 mg mmRNA or as low as 0.02 ng mmRNA for an intramuscular injection into the hind limb of the mouse. For subcutaneous administration, the animals are administered a single subcutaneous dose of formulated mmRNA ranging from 400 mg/kg to doses as low as 1 ng/kg with a preferred range to be 80 mg/kg to 100 ng/kg. A maximum dose for subcutaneous administration, for a mouse, is roughly 8 mg mmRNA or as low as 0.02 ng mmRNA.

For a 20 gram mouse the volume of a single intramuscular injection is maximally 0.025 ml and a single subcutaneous injection is maximally 0.2 ml. The optimal dose of mmRNA administered is calculated from the body weight of the animal. At various points in time points following the administration of the mmRNA-lipidoid, serum, tissues, and tissue lysates is obtained and the level of the mmRNA-encoded product is determined. The ability of lipidoid-formulated luciferase, green fluorescent protein (GFP), mCherry fluorescent protein, secreted alkaline phosphatase (sAP), human G-CSF, human factor IX, or human Erythropoietin (EPO) mmRNA to express the desired protein product is confirmed by luminescence for luciferase expression, flow cytometry for GFP and mCherry expression, by enzymatic activity for sAP, and by ELISA for G-CSF, Factor IX and Erythropoietin (EPO) secretion.

Additional studies for a multi-dose regimen are also performed to determine the maximal expression using mmRNA, to evaluate the saturability of the mmRNA-driven expression (achieved by giving a control and active mmRNA formulation in parallel or in sequence), and to determine the feasibility of repeat drug administration (by giving mmRNA in doses separated by weeks or months and then determining whether expression level is affected by factors such as immunogenicity). Studies utilizing multiple subcutaneous or intramuscular injection sites at one time point, are also utilized to further increase mmRNA drug exposure and improve protein production. An assessment of the physiological function of proteins, such as GFP, mCherry, sAP, human G-CSF, human factor IX, and human EPO, are determined through analyzing samples from the tested animals and detecting a change in granulocyte and/or red blood cell counts. Activity of an expressed protein product such as Factor IX, in animals can also be assessed through analysis of Factor IX enzymatic activity (such as an activated partial thromboplastin time assay) and effect of clotting times.

Example 33

Bifunctional mmRNA

Using the teachings and synthesis methods described herein, modified RNAs are designed and synthesized to be bifunctional, thereby encoding one or more cytotoxic protein molecules as well as be synthesized using cytotoxic nucleosides.

Administration of the bifunctional modified mRNAs is effected using either saline or a lipid carrier. Once administered, the bifunctional modified mRNA is translated to produce the encoded cytotoxic peptide. Upon degradation of the delivered modified mRNA, the cytotoxic nucleosides are released which also effect therapeutic benefit to the subject.

Example 34

Modified mRNA Transfection

A. Reverse Transfection

For experiments performed in a 24-well collagen-coated tissue culture plate, Keratinocytes are seeded at a cell density of $1\times10^5$. For experiments performed in a 96-well collagen-coated tissue culture plate, Keratinocytes are seeded at a cell density of $0.5\times10^5$. For each modified mRNA (mmRNA) to be transfected, modified mRNA: RNAIMAX™ is prepared as described and mixed with the cells in the multi-well plate within a period of time, e.g., 6 hours, of cell seeding before cells had adhered to the tissue culture plate.

B. Forward Transfection

In a 24-well collagen-coated tissue culture plate, Keratinocytes are seeded at a cell density of $0.7\times10^5$. For experiments performed in a 96-well collagen-coated tissue culture plate, Keratinocytes are seeded at a cell density of $0.3\times10^5$. Keratinocytes are grown to a confluency of >70% for over 24 hours. For each modified mRNA (mmRNA) to be transfected, modified mRNA: RNAIMAX™ is prepared as described and transfected onto the cells in the multi-well plate over 24 hours after cell seeding and adherence to the tissue culture plate.

C. Modified mRNA Translation Screen: G-CSF ELISA

Keratinocytes are grown in EPILIFE medium with Supplement S7 from Invitrogen (Carlsbad, Calif.) at a confluence of >70%. One set of keratinocytes were reverse transfected with 300 ng of the chemically modified mRNA (mmRNA) complexed with RNAIMAX™ from Invitrogen. Another set of keratinocytes are forward transfected with 300 ng modified mRNA complexed with RNAIMAX™ from Invitrogen. The modified mRNA: RNAIMAX™ complex is formed by first incubating the RNA with Supplement-free EPILIFE® media in a 5× volumetric dilution for 10 minutes at room temperature.

In a second vial, RNAIMAX™ reagent was incubated with Supplement-free EPILIFE® Media in 10× volumetric dilution for 10 minutes at room temperature. The RNA vial was then mixed with the RNAIMAX™ vial and incubated for 20-30 minutes at room temperature before being added to the cells in a drop-wise fashion. Secreted human Granulocyte-Colony Stimulating Factor (G-CSF) concentration in the culture medium is measured at 18 hours post-transfection for each of the chemically modified mRNA in triplicate.

Secretion of Human G-CSF from transfected human keratinocytes is quantified using an ELISA kit from Invitrogen or R&D Systems (Minneapolis, Minn.) following the manufacturers recommended instructions.

D. Modified mRNA Dose and Duration: G-CSF ELISA

Keratinocytes are grown in EPILIFE® medium with Supplement S7 from Invitrogen at a confluence of >70%. Keratinocytes are reverse transfected with either 0 ng, 46.875 ng, 93.75 ng, 187.5 ng, 375 ng, 750 ng, or 1500 ng modified mRNA complexed with the RNAIMAX™ from Invitrogen (Carlsbad, Calif.). The modified mRNA:RNAIMAX™ complex is formed as described. Secreted human G-CSF concentration in the culture medium is measured at 0, 6, 12, 24, and 48 hours post-transfection for each concentration of each modified mRNA in triplicate. Secretion of human G-CSF from transfected human keratinocytes is quantified using an ELISA kit from Invitrogen or R&D Systems following the manufacturers recommended instructions.

Example 35

Split Dose Studies

Studies utilizing multiple subcutaneous or intramuscular injection sites at one time point were designed and performed to investigate ways to increase mmRNA drug exposure and improve protein production. In addition to detection of the expressed protein product, an assessment of the physiological function of proteins was also determined through analyzing samples from the animal tested.

Surprisingly, it has been determined that split dosing of mmRNA produces greater protein production and phenotypic responses than those produced by single unit dosing or multi-dosing schemes.

The design of a single unit dose, multi-dose and split dose experiment involved using human erythropoietin (EPO) mmRNA (mRNA shown in SEQ ID NO: 33900; polyA tail of approximately 160 nucleotides not shown in sequence; 5'cap, Cap1) administered in buffer alone. The dosing vehicle (F. buffer) consisted of 150 mM NaCl, 2 mM $CaCl_2$, 2 mM $Na^+$-phosphate (1.4 mM monobasic sodium phosphate; 0.6 mM dibasic sodium phosphate), and 0.5 mM EDTA, pH 6.5. The pH was adjusted using sodium hydroxide and the final solution was filter sterilized. The mmRNA was modified with 5meC at each cytosine and pseudouridine replacement at each uridine site.

Animals (n=5) were injected IM (intramuscular) for the single unit dose of 100 ug. For multi-dosing, two schedules were used, 3 doses of 100 ug and 6 doses of 100 ug. For the split dosing scheme, two schedules were used, 3 doses at 33.3 ug and 6 doses of 16.5 ug mmRNA. Control dosing involved use of buffer only at 6 doses. Control mmRNA involved the use of luciferase mmRNA (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) dosed 6 times at 100 ug. Blood and muscle tissue were evaluated 13 hrs post injection.

Human EPO protein was measured in mouse serum 13 h post I.M. single, multi- or split dosing of the EPO mmRNA in buffer. Seven groups of mice (n=5 mice per group) were treated and evaluated. The results are shown in Table 59.

TABLE 59

Split dose study

| Group | Treatment | Dose of mmRNA | Total Dose | Avg. pmol/mL human EPO | Polypeptide per unit drug (pmol/ug) | Dose Splitting Factor |
|---|---|---|---|---|---|---|
| 1 | Human EPO mmRNA | 1 × 100 ug | 100 ug | 14.3 | .14 | 1 |
| 2 | Human EPO mmRNA | 3 × 100 ug | 300 ug | 82.5 | .28 | 2 |
| 3 | Human EPO mmRNA | 6 × 100 ug | 600 ug | 273.0 | .46 | 3.3 |

TABLE 59-continued

Split dose study

| Group | Treatment | Dose of mmRNA | Total Dose | Avg. pmol/mL human EPO | Polypeptide per unit drug (pmol/ug) | Dose Splitting Factor |
|---|---|---|---|---|---|---|
| 4 | Human EPO mmRNA | 3 × 33.3 ug | 100 ug | 104.7 | 1.1 | 7.9 |
| 5 | Human EPO mmRNA | 6 × 16.5 ug | 100 ug | 127.9 | 1.3 | 9.3 |
| 6 | Luciferase mmRNA | 6 × 100 ug | 600 ug | 0 | — | — |
| 7 | Buffer Alone | — | — | 0 | — | — |

The splitting factor is defined as the product per unit drug divided by the single dose product per unit drug (PUD). For example for treatment group 2 the value 0.28 or product (EPO) per unit drug (mmRNA) is divided by the single dose product per unit drug of 0.14. The result is 2. Likewise, for treatment group 4, the value 1.1 or product (EPO) per unit drug (mmRNA) is divided by the single dose product per unit drug of 0.14. The result is 7.9. Consequently, the dose splitting factor (DSF) may be used as an indicator of the efficacy of a split dose regimen. For any single administration of a total daily dose, the DSF should be equal to 1. Therefore any DSF greater than this value in a split dose regimen is an indication of increased efficacy.

To determine the dose response trends, impact of injection site and impact of injection timing, studies are performed. In these studies, varied doses of 1 ug, 5 ug, 10 ug, 25 ug, 50 ug, and values in between are used to determine dose response outcomes. Split dosing for a 100 ug total dose includes three or six doses of 1.6 ug, 4.2 ug, 8.3 ug, 16.6 ug, or values and total doses equal to administration of the total dose selected.

Injection sites are chosen from the limbs or any body surface presenting enough area suitable for injection. This may also include a selection of injection depth to target the dermis (Intradermal), epidermis (Epidermal), subcutaneous tissue (SC) or muscle (IM). Injection angle will vary based on targeted delivery site with injections targeting the intradermal site to be 10-15 degree angles from the plane of the surface of the skin, between 20-45 degrees from the plane of the surface of the skin for subcutaneous injections and angles of between 60-90 degrees for injections substantially into the muscle.

Example 36

Quantification in Exosomes

The quantity and localization of the mmRNA of the present invention can be determined by measuring the amounts (initial, timecourse, or residual basis) in isolated exosomes. In this study, since the mmRNA are typically codon-optimized and distinct in sequence from endogenous mRNA, the levels of mmRNA are quantitated as compared to endogenous levels of native or wild type mRNA by using the methods of Gibbings, PCT/IB2009/005878, the contents of which are incorporated herein by reference in their entirety.

In these studies, the method is performed by first isolating exosomes or vesicles preferably from a bodily fluid of a patient previously treated with a polynucleotide, primary construct or mmRNA of the invention, then measuring, in said exosomes, the polynucleotide, primary construct or mmRNA levels by one of mRNA microarray, qRT-PCR, or other means for measuring RNA in the art including by suitable antibody or immunohistochemical methods.

Example 37

Effect of Modified mRNA on Cellular Viability, Cytotoxicity and Apoptosis

This experiment demonstrates cellular viability, cytotoxicity and apoptosis for distinct modified mRNA in-vitro transfected Human Keratinocyte cells. Keratinocytes are grown in EPILIFE® medium with Human Keratinocyte Growth Supplement in the absence of hydrocortisone from Invitrogen (Carlsbad, Calif.) at a confluence of >70%. Keratinocytes are reverse transfected with 0 ng, 46.875 ng, 93.75 ng, 187.5 ng, 375 ng, 750 ng, 1500 ng, 3000 ng, or 6000 ng of modified mRNA complexed with RNAIMAX™ from Invitrogen. The modified mRNA:RNAIMAX™ complex is formed. Secreted human G-CSF concentration in the culture medium is measured at 0, 6, 12, 24, and 48 hours post-transfection for each concentration of each modified m RNA in triplicate. Secretion of human G-CSF from transfected human keratinocytes is quantified using an ELISA kit from Invitrogen or R&D Systems following the manufacturers recommended instructions.

Cellular viability, cytotoxicity and apoptosis is measured at 0, 12, 48, 96, and 192 hours post-transfection using the APO-TOX-GLO™ kit from Promega (Madison, Wis.) according to manufacturer instructions.

Example 38

Detection of a Cellular Innate Immune Response to Modified mRNA Using an ELISA Assay An enzyme-linked immunosorbent assay (ELISA) for Human Tumor Necrosis Factor-α (TNF-α), Human Interferon-β (IFN-β) and Human Granulocyte-Colony Stimulating Factor (G-CSF) secreted from in vitro-transfected Human Keratinocyte cells is tested for the detection of a cellular innate immune response. Keratinocytes are grown in EPILIFE® medium with Human Keratinocyte Growth Supplement in the absence of hydrocortisone from Invitrogen (Carlsbad, Calif.) at a confluence of >70%. Secreted TNF-α keratinocytes are reverse transfected with 0 ng, 93.75 ng, 187.5 ng, 375 ng, 750 ng, 1500 ng or 3000 ng of the chemically modified mRNA (mmRNA) complexed with RNAIMAX™ from Invitrogen as described in triplicate. Secreted TNF-α in the culture medium is measured 24 hours post-transfection for each of the chemically modified mRNA using an ELISA kit from Invitrogen according to the manufacturer protocols.

Secreted IFN-β in the same culture medium is measured 24 hours post-transfection for each of the chemically modified mRNA using an ELISA kit from Invitrogen according to the manufacturer protocols. Secreted human G-CSF concentration in the same culture medium is measured at 24 hours post-transfection for each of the chemically modified mRNA.

Secretion of human G-CSF from transfected human keratinocytes is quantified using an ELISA kit from Invitrogen or R&D Systems (Minneapolis, Minn.) following the manufacturers recommended instructions. These data indicate which modified mRNA (mmRNA) are capable eliciting a reduced cellular innate immune response in comparison to natural and other chemically modified polynucleotides or reference compounds by measuring exemplary type 1 cytokines TNF-α and IFN-β.

Example 39

Human Granulocyte-Colony Stimulating Factor (G-CSF) Modified mRNA-Induced Cell Proliferation Assay Human keratinocytes are grown in EPILIFE® medium with Supplement S7 from Invitrogen at a confluence of >70% in a 24-well collagen-coated TRANSWELL® (Coming, Lowell, Mass.) co-culture tissue culture plate. Keratinocytes are reverse transfected with 750 ng of the indicated chemically modified mRNA (mmRNA) complexed with RNAIMAX from Invitrogen as described in triplicate. The modified mRNA:RNAIMAX complex is formed as described. Keratinocyte media is exchanged 6-8 hours post-transfection. 42-hours post-transfection, the 24-well TRANSWELL® plate insert with a 0.4 μm-pore semi-permeable polyester membrane is placed into the human G-CSF modified mRNA-transfected keratinocyte containing culture plate Human myeloblast cells, Kasumi-1 cells or KG-1 ($0.2 \times 10^5$ cells), are seeded into the insert well and cell proliferation is quantified 42 hours post-co-culture initiation using the CyQuant Direct Cell Proliferation Assay (Invitrogen, Carlsbad, Calif.) in a 100-120 μl volume in a 96-well plate. Modified mRNA-encoding human G-CSF-induced myeloblast cell proliferation is expressed as a percent cell proliferation normalized to untransfected keratinocyte/myeloblast co-culture control wells. Secreted human G-CSF concentration in both the keratinocyte and myeloblast insert co-culture wells is measured at 42 hours post-co-culture initiation for each modified mRNA in duplicate. Secretion of human G-CSF is quantified using an ELISA kit from Invitrogen following the manufacturer recommended instructions.

Transfected human G-CSF modified mRNA in human keratinocyte feeder cells and untransfected human myeloblast cells are detected by RT-PCR. Total RNA from sample cells is extracted and lysed using RNEASY® kit (Qiagen, Valencia, Calif.) according to the manufacturer instructions. Extracted total RNA is submitted to RT-PCR for specific amplification of modified mRNA-G-CSF using PROTOSCRIPT® M-MuLV Taq RT-PCR kit (New England BioLabs, Ipswich, Mass.) according to the manufacturer instructions with human G-CSF-specific primers. RT-PCR products are visualized by 1.2% agarose gel electrophoresis.

Example 40

Co-Culture Assay

Modified mRNA comprised of chemically-distinct modified nucleotides encoding human Granulocyte-Colony Stimulating Factor (G-CSF) may stimulate the cellular proliferation of a transfection incompetent cell in a co-culture environment. The co-culture includes a highly transfectable cell type such as a human keratinocyte and a transfection incompetent cell type such as a white blood cell (WBC). The modified mRNA encoding G-CSF are transfected into the highly transfectable cell allowing for the production and secretion of G-CSF protein into the extracellular environment where G-CSF acts in a paracrine-like manner to stimulate the white blood cell expressing the G-CSF receptor to proliferate. The expanded WBC population may be used to treat immune-compromised patients or partially reconstitute the WBC population of an immunosuppressed patient and thus reduce the risk of opportunistic infections.

In another example, a highly transfectable cell such as a fibroblast are transfected with certain growth factors support and simulate the growth, maintenance, or differentiation of poorly transfectable embryonic stem cells or induced pluripotent stem cells.

Example 41

Detection Assays of Human IgG Antibodies

A. ELISA Detection of Human IgG Antibodies

This example describes an ELISA for Human IgG from Chinese Hamster Ovary's (CHO) and Human Embryonic Kidney (HEK, HER-2 Negative) 293 cells transfected with human IgG modified mRNA (mmRNA). The Human Embryonic Embryonic Kidney (HEK) 293 are grown in CD 293 Medium with Supplement of L-Glutamine from Invitrogen until they reach a confluence of 80-90%. The CHO cells are grown in CD CHO Medium with Supplement of L-Glutamine, Hypoxanthine and Thymidine. In one aspect, $2 \times 106$ cells are transfected with 24 μg modified mRNA complexed with RNAIMAX™ from Invitrogen in a 75 cm2 culture flask from Corning in 7 ml of medium. In another aspect, 80,000 cells are transfected with 1 μg modified mRNA complexed with RNAIMAX™ from Invitrogen in a 24-well plate. The modified mRNA:RNAIMAX™ complex is formed by incubating in a vial the mmRNA with either the CD 293 or CD CHO medium in a 5× volumetric dilution for 10 minutes at room temperature. In a second vial, RNAIMAX™ reagent is incubated with CD 293 medium or CD CHO medium in a 10× volumetric dilution for 10 minutes at room temperature. The mmRNA vial is then mixed with the RNAIMAX™ vial and incubated for 20-30 minutes at room temperature before it is added to the CHO or HEK cells in a drop-wise fashion. The culture supernatants are stored at 4 degrees celsius. The concentration of the secreted human IgG in the culture medium in the 24 μg mmRNA transfections is measured at 12, 24, 36 hours post-transfection and the 1 μg mmRNA transfection is measured at 36 hours. Secretion of Trastuzumab from transfected HEK 293 cells is quantified using an ELISA kit from Abcam (Cambridge, Mass.) following the manufacturers recommended instructions. The data shows that a Humanized IgG antibody (such as Trastuzumab) mmRNA is capable of being translated in HEK Cells and that Trastuzumab is secreted out of the cells and released into the extracellular environment. Furthermore, the data demonstrate that transfection of cells with mmRNA encoding Trastuzumab for the production of secreted protein can be scaled up to a bioreactor or large cell culture conditions.

B. Western Detection of Modified mRNA Produced Human IgG Antibody

A Western Blot of CHO-K1 cells is co-transfected with 1 μg each of Heavy and Light Chain of Trastuzumab modified mRNA (mmRNA). CHO cells are grown using standard protocols in 24-well plates. The cell supernatants or cell lysates are collected 24 hours post-transfection, separated on a 12% SDS-Page gel and transferred onto a nitrocellulose membrane using the IBOT® by Invitrogen (Carlsbad, Calif.). The cells are incubated with a first conjugation of a rabbit polyclonal antibody to Human IgG conjugated to DYLIGHT594 (ab96904, abcam, Cambridge, Mass.) and a second conjugation of a goat polyclonal antibody to Rb IgG which is conjugated to alkaline phosphatase. After incubation, the antibody is detected using Novex® alkaline phosphatase chromogenic substrate by Invitrogen (Carlsbad, Calif.).

C. Cell Immuno Staining of Modified mRNA Produced Trastuzumab and Rituximab

CHO-K1 cells are co-transfected with 500 ng each of Heavy and Light Chain of either Trastuzumab or Rituximab. Cells are grown in F-12K Medium from GIBCO® (Grand Island, N.Y.) and 10% FBS. Cells are fixed with 4% paraformaldehyde in PBS, permeabilized with 0.1% Triton X-100 in PBS for 5-10 minutes at room temperature and cells are washed 3 times with room temperature PBS. Trastuzumab and Rituximab staining is performed using rabbit polyclonal antibody to Human IgG conjugated to DYLIGHT®594 (ab96904, abcam, Cambridge, Mass.) according to the manufacture's recommended dilutions. Nuclear DNA staining is performed with DAPI dye from Invitrogen (Carlsbad, Calif.). The protein for Trastuzumab and Rituximab is translated and localized to the cytoplasm upon modified mRNA transfections. Pictures are taken 13 hours post-transfection.

D. Binding Immunoblot Assay for Modified mRNA Produced Trastuzumab and Rituximab Trastuzumab and Rituximab are detected using a binding immunoblot detection assay. Varying concentrations (100 ng/ul to 0 ng/ul) of the ErB2 peptide (ab40048, abeam, Cambridge, Mass.), antigen for Trastuzumab and the CD20 peptide (ab97360, abeam, Cambridge, Mass.), antigen for Rituximab are run on a 12% SDS-Page gel and transferred onto a membrane using the iBlot from Invitrogen. The membranes are incubated for 1 hour with their respective cell supernatants from CHO-K1 cells which are co-transfected with 500 ng each of Heavy and Light Chain of either Trastuzumab or Rituximab. The membranes are blocked with 1% BSA and a secondary anti-human IgG antibody conjugated to alkaline phosphatase (abcam, Cambridge, Mass.) is added. Antibody detection is conducted using the NOVEX alkaline phosphatase chromogenic substrate by Invitrogen (Carlsbad, Calif.). The data shows that a humanized IgG antibodies generated from modified mRNA is capable of recognizing and binding to their respective antigens.

E. Cell Proliferation Assay

The SK-BR-3 cell line, an adherent cell line derived from a human breast adenocarcinoma, which overexpresses the HER2/neu receptor can be used to compare the anti-proliferative properties of modified mRNA (mmRNA) generated Trastuzumab. Varying concentrations of purified Trastuzumab generated from modified mRNA and trastuzumab are be added to cell cultures, and their effects on cell growth are be assessed in triplicate cytotoxicity and viability assays.

Example 42

Bulk Transfection of Modified mRNA into Cell Culture

A. Cationic Lipid Delivery Vehicles

RNA transfections are carried out using RNAIMAX™ (Invitrogen, Carlsbad, Calif.) or TRANSIT-mRNA (Mirus Bio, Madison, Wis.) cationic lipid delivery vehicles. RNA and reagent are first diluted in Opti-MEM basal media (Invitrogen, Carlsbad, Calif.). 100 ng/uL RNA is diluted 5× and 5 µL, of RNAiMax per µg of RNA is diluted 10×. The diluted components are pooled and incubated 15 minutes at room temperature before they are dispensed to culture media. For TRANSIT-mRNA transfections, 100 ng/uL RNA is diluted 10× in Opti-MEM and BOOST reagent is added (at a concentration of 2 µL, per µg of RNA), TRANSIT-mRNA is added (at a concentration of 2 µL, per µg of RNA), and then the RNA-lipid complexes are delivered to the culture media after a 2-minute incubation at room temperature. RNA transfections are performed in Nutristem xenofree hES media (Stemgent, Cambridge, Mass.) for RiPS derivations, Dermal Cell Basal Medium plus Keratinocyte Growth Kit (ATCC) for keratinocyte experiments, and Opti-MEM plus 2% FBS for all other experiments. Successful introduction of a modified mRNA (mmRNA) into host cells can be monitored using various known methods, such as a fluorescent marker, such as Green Fluorescent Protein (GFP). Successful transfection of a modified mRNA can also be determined by measuring the protein expression level of the target polypeptide by e.g., Western Blotting or immunocytochemistry. Similar methods may be followed for large volume scale-up to multi-liter (5-10,000 L) culture format following similar RNA-lipid complex ratios.

B. Electroporation Delivery of Exogenous Synthetic mRNA Transcripts

Electroporation parameters are optimized by transfecting MRC-5 fibroblasts with in vitro synthetic modified mRNA (mmRNA) transcripts and measuring transfection efficiency by quantitative RT-PCR with primers designed to specifically detect the exogenous transcripts. Discharging a 150 uF capacitor charged to F into $2.5 \times 10^6$ cells suspended in 50 µl of Opti-MEM (Invitrogen, Carlsbad, Calif.) in a standard electroporation cuvette with a 2 mm gap is sufficient for repeated delivery in excess of 10,000 copies of modified mRNA transcripts per cell, as determined using the standard curve method, while maintaining high viability (>70%). Further experiments may reveal that the voltage required to efficiently transfect cells with mmRNA transcripts can depend on the cell density during electroporation. Cell density may vary from $1 \times 10^6$ cell/50 µl to a density of $2.5 \times 10^6$ cells/50 µl and require from 110V to 145V to transfect cells with similar efficiencies measured in transcript copies per cell. Large multi-liter (5-10,000 L) electroporation may be performed similar to large volume flow electroporation strategies similar to methods described with the above described constraints (Li et al., 2002; Geng et al., 2010).

Example 43

In Vivo Delivery Using Lipoplexes

A. Human EPO Modified RNA Lipoplex

A formulation containing 100 µg of modified human erythropoietin mRNA (mRNA shown in SEQ ID NO: 33897; polyA tail of approximately 160 nucleotides not shown in sequence; 5'cap, Cap1) (EPO; fully modified 5-methylcytosine; N1-methylpseudouridine) was lipoplexed with 30% by volume of RNAIMAX™ (Lipoplex-h-Epo-46; Generation 2 or Gen2) in 50-70 uL delivered intramuscularly to four C57/BL6 mice. Other groups consisted of mice receiving an injection of the lipoplexed modified luciferase mRNA (Lipoplex-luc) (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) which served as a control containing 100 µg of modified luciferase mRNA was lipoplexed with 30% by volume of RNAiMAX™ or mice receiving an injection of the formulation buffer as negative control at a dose volume of 65 ul. 13 hours after the intramuscular injection, serum was collected from each mouse to measure the amount of human EPO protein in the mouse serum by human EPO ELISA and the results are shown in Table 60.

TABLE 60

Human EPO Production (IM Injection Route)

| Formualtion | Average |
|---|---|
| Lipoplex-h-Epo-46 | 251.95 |
| Lipoplex-Luc | 0 |
| Formulation Buffer | 0 |

B. Human G-CSF Modified RNA Lipoplex

A formulation containing 100 μg of one of the two types of modified human G-CSF mRNA(mRNA sequence shown in SEQ ID NO: 33897; polyA tail of approximately 160 nucleotides not shown in sequence; 5'cap, Cap1) (G-CSF fully modified with 5-methylcytosine and pseudouridine (G-CSF) or G-CSF fully modified with 5-methylcytosine and N1-methyl-pseudouridine (G-CSF-N1) lipoplexed with 30% by volume of RNAIMAX™ and delivered in 150 uL intramuscularly (I.M), in 150 uL subcutaneously (S.C) and in 225 uL intravenously (I.V) to C57/BL6 mice. Three control groups were administered either 100 μg of modified luciferase mRNA (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) intramuscularly (Luc-unsp I.M.) or 150 μg of modified luciferase mRNA intravenously (Luc-unsp I.V.) or 150 uL of the formulation buffer intramuscularly (Buffer I.M.). 6 hours after administration of a formulation, serum was collected from each mouse to measure the amount of human G-CSF protein in the mouse serum by human G-CSF ELISA and the results are shown in Table 61.

These results demonstrate that both 5-methylcytosine/pseudouridine and 5-methylcytosine/N1-methylpseudouridine modified human G-CSF mRNA can result in specific human G-CSF protein expression in serum when delivered via I.V. or I.M. route of administration in a lipoplex formulation.

TABLE 61

Human G-CSF in Serum (I.M., I.V., S.C. Injection Route)

| Formulation | Route | G-CSF (pg/ml) |
|---|---|---|
| G-CSF | I.M. | 85.6 |
| G-CSF N1 | I.M. | 40.1 |
| G-CSF | S.C. | 3.9 |
| G-CSF N1 | S.C. | 0.0 |
| G-CSF | I.V. | 31.0 |
| G-CSF N1 | I.V. | 6.1 |
| Luc-unsp | I.M. | 0.0 |
| Luc-unsp | I.V. | 0.0 |
| Buffer | I.M. | 0.0 |

C. Human G-CSF Modified RNA Lipoplex Comparison

A formulation containing 100 μg of either modified human G-CSF mRNA lipoplexed with 30% by volume of RNAIMAX™ with a 5-methylcytosine (5mc) and a pseudouridine (ψ) modification (G-CSF-Gen1-Lipoplex), modified human G-CSF mRNA with a 5mc and ψ modification in saline (G-CSF-Gen1-Saline), modified human G-CSF mRNA with a N1-5-methylcytosine (N1-5mc) and a ψ modification lipoplexed with 30% by volume of RNAIMAX™ (G-CSF-Gen2-Lipoplex), modified human G-CSF mRNA with a N1-5mc and ψ modification in saline (G-CSF-Gen2-Saline), modified luciferase with a 5mc and ψ modification lipoplexed with 30% by volume of RNAIMAX™ (Luc-Lipoplex), or modified luciferase mRNA with a a 5mc and ψ modification in saline (Luc-Saline) was delivered intramuscularly (I.M.) or subcutaneously (S.C.) and a control group for each method of administration was giving a dose of 80 uL of the formulation buffer (F. Buffer) to C57/BL6 mice. 13 hours post injection serum and tissue from the site of injection were collected from each mouse and analyzed by G-CSF ELISA to compare human G-CSF protein levels. The results of the human G-CSF protein in mouse serum from the intramuscular administration, and the subcutaneous administration results are shown in Table 62.

These results demonstrate that 5-methylcytosine/pseudouridine and 5-methylcytosine/N1-methylpseudouridine modified human G-CSF mRNA can result in specific human G-CSF protein expression in serum when delivered via I.M. or S.C. route of administration whether in a saline formulation or in a lipoplex formulation. As shown in Table 62, 5-methylcytosine/N1-methyl-pseudouridine modified human G-CSF mRNA generally demonstrates increased human G-CSF protein production relative to 5-methylcytosine/pseudouridine modified human G-CSF mRNA.

TABLE 62

Human G-CSF Protein in Mouse Serum

| | G-CSF (pg/ml) | |
|---|---|---|
| Formulation | I.M. Injection Route | S.C. Injenction Route |
| G-CSF-Gen1-Lipoplex | 13.988 | 42.855 |
| GCSF-Gen1-saline | 9.375 | 4.614 |
| GCSF-Gen2-lipoplex | 75.572 | 32.107 |
| GCSF-Gen2-saline | 20.190 | 45.024 |
| Luc lipoplex | 0 | 3.754 |
| Luc saline | 0.0748 | 0 |
| F. Buffer | 4.977 | 2.156 |

D. mCherry Modified RNA Lipoplex Comparison

Intramuscular and Subcutaneous Administration

A formulation containing 100 μg of either modified mCherry mRNA (mRNA sequence shown in SEQ ID NO: 33898; polyA tail of approximately 160 nucleotides not shown in sequence; 5'cap, Cap1) lipoplexed with 30% by volume of RNAIMAX™ or modified mCherry mRNA in saline is delivered intramuscularly and subcutaneously to mice. A formulation buffer is also administered to a control group of mice either intramuscularly or subcutaneously. The site of injection on the mice may be collected 17 hours post injection for sectioning to determine the cell type(s) responsible for producing protein.

Intravitreal Administration

A formulation containing 10 μg of either modified mCherry mRNA lipoplexed with RNAIMAX™, modified mCherry mRNA in a formulation buffer, modified luciferase mRNA lipoplexed with RNAMAX™, modified luciferase mRNA in a formulation buffer can be administered by intravitreal injection (IVT) in rats in a dose volume of 5 μl/eye. A formulation buffer is also administered by IVT to a control group of rats in a dose volume of 5 μl/eye. Eyes from treated rats can be collected after 18 hours post injection for sectioning and lysating to determine whether mmRNA can be effectively delivered in vivo to the eye and result in protein production, and to also determine the cell type(s) responsible for producing protein in vivo.

Intranasal Administration

A formulation containing 100 µg of either modified mCherry mRNA lipoplexed with 30% by volume of RNAIMAX™, modified mCherry mRNA in saline, modified luciferase mRNA lipoplexed with 30% by volume of RNAIMAX™ or modified luciferase mRNA in saline is delivered intranasally. A formulation buffer is also administered to a control group intranasally. Lungs may be collected about 13 hours post instillation for sectioning (for those receiving mCherry mRNA) or homogenization (for those receiving luciferase mRNA). These samples will be used to determine whether mmRNA can be effectively delivered in vivo to the lungs and result in protein production, and to also determine the cell type(s) responsible for producing protein in vivo.

Example 44

In Vivo Delivery Using Varying Lipid Ratios

Modified mRNA was delivered to C57/BL6 mice to evaluate varying lipid ratios and the resulting protein expression. Formulations of 100 µg modified human EPO mRNA (mRNA shown in SEQ ID NO: 33900; polyA tail of approximately 160 nucleotides not shown in sequence; 5'cap, Cap1; fully modified with 5-methylcytosine and pseudouridine) lipoplexed with 10%, 30% or 50% RNAIMAX™, 100 µg modified luciferase mRNA (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) lipoplexed with 10%, 30% or 50% RNAIMAX™ or a formulation buffer were administered intramuscularly to mice in a single 70 µl dose. Serum was collected 13 hours post injection to undergo a human EPO ELISA to determine the human EPO protein level in each mouse. The results of the human EPO ELISA, shown in Table 63, show that modified human EPO expressed in the muscle is secreted into the serum for each of the different percentage of RNAIMAX™.

TABLE 63

Human EPO Protein in Mouse Serum (IM Injection Route)

| Formulation | EPO (pg/ml) |
|---|---|
| Epo + 10% RNAiMAX | 11.4 |
| Luc + 10% RNAiMAX | 0 |
| Epo + 30% RNAiMAX | 27.1 |

TABLE 63-continued

Human EPO Protein in Mouse Serum (IM Injection Route)

| Formulation | EPO (pg/ml) |
|---|---|
| Luc + 30% RNAiMAX | 0 |
| Epo + 50% RNAiMAX | 19.7 |
| Luc + 50% RNAiMAX | 0 |
| F. Buffer | 0 |

Example 45

Intramuscular and Subcutaneous In Vivo Delivery in Mammals

Modified human EPO mRNA (mRNA sequence shown in SEQ ID NO: 33900; polyA tail of approximately 160 nucleotides not shown in sequence; 5'cap, Cap1; fully modified with 5-methylcytosine and pseudouridine) formulated in saline was delivered to either C57/BL6 mice or Sprague-Dawley rats to evaluate the dose dependency on human EPO production. Rats were intramuscularly injected with 50 µl of the modified human EPO mRNA (h-EPO), modified luciferase mRNA (Luc) (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) or the formulation buffer (F.Buffer) as described in the dosing chart Table 64.

Mice were intramuscularly or subcutaneously injected with 50 µl of the modified human EPO mRNA (h-EPO), modified luciferase mRNA (Luc) or the formulation buffer (F.Buffer) as described in the dosing chart Table 65. 13 hours post injection blood was collected and serum was analyzed to determine the amount human EPO for each mouse or rat. The average and geometric mean in pg/ml for the rat study are also shown in Table 64.

TABLE 64

Rat Study

| Group | | Dose (ug) | R#1 | R#2 | R#3 | R#4 | R#5 | R#6 | Avg. pg/ml | Geometric mean pg/ml |
|---|---|---|---|---|---|---|---|---|---|---|
| h-EPO | G#1 | 150 | 61.8 | 86.3 | 69.9 | 55.2 | 59 | 74.2 | 67.7 | 67.1 |
| h-EPO | G#2 | 100 | 69.4 | 77.8 | 48.2 | 17.6 | 101.9 | 161.5 | 79.4 | 66.9 |
| h-EPO | G#3 | 50 | 143.6 | 60.9 | 173.4 | 145.9 | 61.5 | 23.9 | 101.5 | 85.4 |
| h-EPO | G#4 | 10 | 7.8 | 11.8 | 30.9 | 36.2 | 40.6 | 150.3 | 46.3 | 31.2 |
| h-EPO | G#5 | 1 | 9.1 | 35.8 | — | 46.2 | 18.1 | 34.1 | 28.7 | 25.4 |
| Luc | G#6 | 100 | 34.1 | 36.5 | 13.5 | 13.7 | — | — | 24.5 | 22.4 |
| F. Buffer | G#7 | — | — | 14.7 | 18.5 | 21.2 | 20.3 | — | 18.7 | 18.5 |

TABLE 65

Mouse Study

| Route | Treatment | Group | Dose | Average Level in serum pg/ml |
|---|---|---|---|---|
| IM | h-EPO | 1 | 100 µg | 96.2 |
| IM | h-EPO | 2 | 50 µg | 63.5 |
| IM | h-EPO | 3 | 25 µg | 18.7 |
| IM | h-EPO | 4 | 10 µg | 25.9 |
| IM | h-EPO | 5 | 1 µg | 2.6 |
| IM | Luc | 6 | 100 µg | 0 |
| IM | F. Buffer | 7 | — | 1.0 |
| SC | h-EPO | 1 | 100 µg | 72.0 |

TABLE 65-continued

Mouse Study

| Route | Treatment | Group | Dose | Average Level in serum pg/ml |
|---|---|---|---|---|
| SC | Luc | 2 | 100 μg | 26.7 |
| SC | F. Buffer | 3 | — | 17.4 |

Example 46

Duration of Activity after Intramuscular In Vivo Delivery in Rats

Modified human EPO mRNA (mRNA sequence shown in SEQ ID NO: 33900; polyA tail of approximately 160 nucleotides not shown in sequence; 5'cap, Cap1; fully modified with 5-methylcytosine and pseudouridine) formulated in formulation buffer was delivered to Sprague-Dawley rats to determine the duration of the dose response. Rats were intramuscularly injected with 50 μl of the modified human EPO mRNA (h-EPO), modified luciferase mRNA(IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) (Luc) or the formulation buffer (F.Buffer) as described in the dosing chart Table 66. The rats were bled 2, 6, 12, 24, 48 and 72 hours after the intramuscular injection to determine the concentration of human EPO in serum at a given time. The average and geometric mean in pg/ml for this study are also shown in Table 66.

TABLE 66

Dosing Chart

| Group | Dose (ug) | Avg. pg/ml | Geometric-mean (pg/ml) |
|---|---|---|---|
| h-EPO | 2 hour | 100 | 59.6 | 58.2 |
| h-EPO | 6 hour | 100 | 68.6 | 55.8 |
| h-EPO | 12 hour | 100 | 87.4 | 84.5 |
| h-EPO | 24 hour | 100 | 108.6 | 95.3 |
| h-EPO | 48 hour | 100 | 77.9 | 77.0 |
| h-EPO | 72 hour | 100 | 80.1 | 75.8 |
| Luc | 24, 48 and 72 hour | 100 | 37.2 | 29.2 |
| F.Buffer | 24, 48 and 72 hour | — | 48.9 | 10.4 |

Example 47

Routes of Administration

Further studies were performed to investigate dosing using different routes of administration. Following the protocol outlined in Example 35, 4 mice per group were dosed intramuscularly (I.M.), intravenously (IV) or subcutaneously (S.C.) by the dosing chart outlined in Table 67. Serum was collected 13 hours post injection from all mice, tissue was collected from the site of injection from the intramuscular and subcutaneous group and the spleen, liver and kidneys were collected from the intravenous group. The results from the intramuscular group and the subcutaneous group results are shown in Table 68.

TABLE 67

Dosing Chart

| Group | Treatment | Route | Dose of mmRNA | Total Dose | Dosing Vehicle |
|---|---|---|---|---|---|
| 1 | Lipoplex-human EPO mmRNA | I.M. | 4 × 100 ug + 30% Lipoplex | 4 × 70 ul | Lipoplex |
| 2 | Lipoplex-human EPO mmRNA | I.M. | 4 × 100 ug | 4 × 70 ul | Buffer |
| 3 | Lipoplex-human EPO mmRNA | S.C. | 4 × 100 ug + 30% Lipoplex | 4 × 70 ul | Lipoplex |
| 4 | Lipoplex-human EPO mmRNA | S.C. | 4 × 100 ug | 4 × 70 ul | Buffer |
| 5 | Lipoplex-human EPO mmRNA | I.V. | 200 ug + 30% Lipoplex | 140 ul | Lipoplex |
| 6 | Lipoplexed-Luciferase mmRNA | I.M. | 100 ug + 30% Lipoplex | 4 × 70 ul | Lipoplex |
| 7 | Lipoplexed-Luciferase mmRNA | I.M. | 100 ug | 4 × 70 ul | Buffer |
| 8 | Lipoplexed-Luciferase mmRNA | S.C. | 100 ug + 30% Lipoplex | 4 × 70 ul | Lipoplex |
| 9 | Lipoplexed-Luciferase mmRNA | S.C. | 100 ug | 4 × 70 ul | Buffer |
| 10 | Lipoplexed-human EPO mmRNA | I.V. | 200 ug + 30% Lipoplex | 140 ul | Lipoplex |
| 11 | Formulation Buffer | I.M. | 4x multi dosing | 4 × 70 ul | Buffer |

TABLE 68

Human EPO Protein in Mouse Serum (I.M. Injection Route)

| | EPO (pg/ml) | |
|---|---|---|
| Formulation | I.M. Injection Route | S.C. Injection Route |
| Epo-Lipoplex | 67.115 | 2.154 |
| Luc-Lipoplex | 0 | 0 |
| Epo-Saline | 100.891 | 11.37 |
| Luc-Saline | 0 | 0 |
| Formulation Buffer | 0 | 0 |

Example 48

Rapidly Eliminated Lipid Nanoparticle (reLNP) Studies

A. Formulation of Modified RNA reLNPs

Solutions of synthesized lipid, 1,2-distearoyl-3-phosphatidylcholine (DSPC) (Avanti Polar Lipids, Alabaster, Ala.), cholesterol (Sigma-Aldrich, Taufkirchen, Germany), and α-[3'-(1,2-dimyristoyl-3-propanoxy)-carboxamide-propyl]-ω-methoxy-polyoxyethylene (PEG-c-DOMG) (NOF, Bouwelven, Belgium) are prepared and stored at −20° C. The synthesized lipid is selected from DLin-DMA with an internal ester, DLin-DMA with a terminal ester, DLin-MC3-DMA-internal ester, and DLin-MC3-DMA with a terminal ester. The reLNPs are combined to yield a molar ratio of 50:10:38.5:1.5 (reLNP: DSPC: Cholesterol: PEG-c-DOMG). Formulations of the reLNPs and modified mRNA are prepared by combining the lipid solution with the modified mRNA solution at total lipid to modified mRNA weight ratio of 10:1, 15:1, 20:1 and 30:1.

B. Characterization of Formulations

A Zetasizer Nano ZS (Malvern Instruments Ltd, Malvern, Worcestershire, UK) is used to determine the particle size, the polydispersity index (PDI) and the zeta potential of the modified mRNA nanoparticles in 1×PBS in determining particle size and 15 mM PBS in determining zeta potential.

Ultraviolet-visible spectroscopy is used to determine the concentration of modified mRNA nanoparticle formulation. After mixing, the absorbance spectrum of the solution is recorded between 230 nm and 330 nm on a DU 800 spectrophotometer (Beckman Coulter, Beckman Coulter, Inc., Brea, Calif.). The modified RNA concentration in the nanoparticle formulation is calculated based on the extinction coefficient of the modified RNA used in the formulation and on the difference between the absorbance at a wavelength of 260 nm and the baseline value at a wavelength of 330 nm.

QUANT-IT™ RIBOGREEN® RNA assay (Invitrogen Corporation Carlsbad, Calif.) is used to evaluate the encapsulation of modified RNA by the nanoparticle. The samples are diluted, transferred to a polystyrene 96 well plate, then either a TE buffer or a 2% Triton X-100 solution is added. The plate is incubated and the RIBOGREEN® reagent is diluted in TE buffer, and of this solution is added to each well. The fluorescence intensity is measured using a fluorescence plate reader (Wallac Victor 1420 Multilablel Counter; Perkin Elmer, Waltham, Mass.) The fluorescence values of the reagent blank are subtracted from each of the samples and the percentage of free modified RNA is determined by dividing the fluorescence intensity of the intact sample by the fluorescence value of the disrupted sample.

C. In Vitro Incubation

Human embryonic kidney epithelial (HEK293) and hepatocellular carcinoma epithelial (HepG2) cells (LGC standards GmbH, Wesel, Germany) are seeded on 96-well plates (Greiner Bio-one GmbH, Frickenhausen, Germany) and plates for HEK293 cells are precoated with collagen type1. HEK293 are seeded at a density of about 30,000 and HepG2 are seeded at a density of about 35,000 cells per well in 100 µl cell culture medium. Formulations containing mCherry mRNA (mRNA sequence shown in SEQ ID NO: 33898; polyA tail of approximately 160 nucleotides not shown in sequence; 5'cap, Cap1) are added directly after seeding the cells and incubated. The mCherry cDNA with the T7 promoter, 5' untranslated region (UTR) and 3' UTR used in in vitro transcription (IVT) is given in SEQ ID NO: 33899.

Cells are harvested by transferring the culture media supernatants to a 96-well Pro-Bind U-bottom plate (Beckton Dickinson GmbH, Heidelberg, Germany). Cells are trypsinized with ½ volume Trypsin/EDTA (Biochrom AG, Berlin, Germany), pooled with respective supernatants and fixed by adding one volume PBS/2% FCS (both Biochrom AG, Berlin, Germany)/0.5% formaldehyde (Merck, Darmstadt, Germany). Samples are then submitted to a flow cytometer measurement with an excitation laser and a filter for PE-Texas Red in a LSRII cytometer (Beckton Dickinson GmbH, Heidelberg, Germany). The mean fluorescence intensity (MFI) of all events and the standard deviation of four independent wells are presented in for samples analyzed.

D. In Vivo Formulation Studies

Mice are administered intravenously a single dose of a formulation containing a modified mRNA and a reLNP. The modified mRNA administered to the mice is selected from G-CSF (mRNA sequence shown in SEQ ID NO: 33897; polyA tail of approximately 160 nucleotides not shown in sequence; 5'cap, Cap1), Factor IX (mRNA shown in SEQ ID NO: 33901; polyA tail of approximately 160 nucleotides not shown in sequence; 5'cap, Cap1) or mCherry (mRNA sequence shown in SEQ ID NO: 33898; polyA tail of approximately 160 nucleotides not shown in sequence; 5'cap, Cap1).

The mice are injected with 100 ug, 10 ug or 1 ug of the formulated modified mRNA and are sacrificed 8 hours after they are administered the formulation. Serum from the mice administered formulations containing human G-CSF modified mRNA are measured by specific G-CSF ELISA and serum from mice administered human Factor IX modified RNA is analyzed by specific factor IX ELISA or chromogenic assay. The liver and spleen from the mice administered with mCherry modified mRNA are analyzed by immunohistochemistry (IHC) or fluorescence-activated cell sorting (FACS). As a control, a group of mice are not injected with any formulation and their serum and tissue are collected analyzed by ELISA, FACS and/or IHC.

Example 49

In Vitro Transfection of VEGF-A

Human vascular endothelial growth factor-isoform A (VEGF-A) modified mRNA (mRNA sequence shown in SEQ ID NO: 33910; polyA tail of approximately 160 nucleotides not shown in sequence; 5'cap, Cap1) was transfected via reverse transfection in Human Keratinocyte cells in 24 multi-well plates. Human Keratinocytes cells were grown in EPILIFE® medium with Supplement S7 from Invitrogen (Carlsbad, Calif.) until they reached a confluence of 50-70%. The cells were transfected with 0, 46.875, 93.75, 187.5, 375, 750, and 1500 ng of modified mRNA (mmRNA) encoding VEGF-A which had been complexed with RNAIMAX™ from Invitrogen (Carlsbad, Calif.). The RNA:RNAIMAX™ complex was formed by first incubating the RNA with Supplement-free EPILIFE® media in a 5× volumetric dilution for 10 minutes at room temperature. In a second vial, RNAIMAX™ reagent was incubated with Supplement-free EPILIFE® Media in a 10× volumetric dilution for 10 minutes at room temperature. The RNA vial was then mixed with the RNAIMAX™ vial and incubated for 20-30 minutes at room temperature before being added to the cells in a drop-wise fashion.

The fully optimized mRNA encoding VEGF-A (mRNA sequence shown in SEQ ID NO: 33910; polyA tail of approximately 160 nucleotides not shown in sequence; 5'cap, Cap1) transfected with the Human Keratinocyte cells included modifications during translation such as natural nucleoside triphosphates (NTP), pseudouridine at each uridine site and 5-methylcytosine at each cytosine site (pseudo-U/5mC), and N1-methyl-pseudouridine at each uridine site and 5-methylcytosine at each cytosine site (N1-methyl-Pseudo-U/5mC). Cells were transfected with the mmRNA encoding VEGF-A and secreted VEGF-A concentration (pg/ml) in the culture medium was measured at 6, 12, 24, and 48 hours post-transfection for each of the concentrations using an ELISA kit from Invitrogen (Carlsbad, Calif.) following the manufacturers recommended instructions. These data, shown in Table 69, show that modified mRNA encoding VEGF-A is capable of being translated in Human Keratinocyte cells and that VEGF-A is transported out of the cells and released into the extracellular environment.

TABLE 69

VEGF-A Dosing and Protein Secretion

| Dose (ng) | 6 hours (pg/ml) | 12 hours (pg/ml) | 24 hours (pg/ml) | 48 hours (pg/ml) |
|---|---|---|---|---|
| VEGF-A Dose Containing Natural NTPs | | | | |
| 46.875 | 10.37 | 18.07 | 33.90 | 67.02 |
| 93.75 | 9.79 | 20.54 | 41.95 | 65.75 |

TABLE 69-continued

VEGF-A Dosing and Protein Secretion

| Dose (ng) | 6 hours (pg/ml) | 12 hours (pg/ml) | 24 hours (pg/ml) | 48 hours (pg/ml) |
|---|---|---|---|---|
| 187.5 | 14.07 | 24.56 | 45.25 | 64.39 |
| 375 | 19.16 | 37.53 | 53.61 | 88.28 |
| 750 | 21.51 | 38.90 | 51.44 | 61.79 |
| 1500 | 36.11 | 61.90 | 76.70 | 86.54 |
| VEGF-A Dose Containing Pseudo-U/5mC | | | | |
| 46.875 | 10.13 | 16.67 | 33.99 | 72.88 |
| 93.75 | 11.00 | 20.00 | 46.47 | 145.61 |
| 187.5 | 16.04 | 34.07 | 83.00 | 120.77 |
| 375 | 69.15 | 188.10 | 448.50 | 392.44 |
| 750 | 133.95 | 304.30 | 524.02 | 526.58 |
| 1500 | 198.96 | 345.65 | 426.97 | 505.41 |
| VEGF-A Dose Containing N1-methyl-Pseudo-U/5mC | | | | |
| 46.875 | 0.03 | 6.02 | 27.65 | 100.42 |
| 93.75 | 12.37 | 46.38 | 121.23 | 167.56 |
| 187.5 | 104.55 | 365.71 | 1025.41 | 1056.91 |
| 375 | 605.89 | 1201.23 | 1653.63 | 1889.23 |
| 750 | 445.41 | 1036.45 | 1522.86 | 1954.81 |
| 1500 | 261.61 | 714.68 | 1053.12 | 1513.39 |

Example 50

In Vivo Studies of Factor IX

Human Factor IX mmRNA (Gen1; fully modified 5-methycytosine and pseudouridine) formulated in formulation buffer was delivered to mice via intramuscular injection. The results demonstrate that Factor IX protein was elevated in serum as measured 13 hours after administration.

In this study, mice (N=5 for Factor IX, N=3 for Luciferase or Buffer controls) were intramuscularly injected with 50 µl of the Factor IX mmRNA (mRNA sequence shown in SEQ ID NO: 33901; polyA tail of approximately 160 nucleotides not shown in sequence; 5'cap, Cap1), Luciferase (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) or the formulation buffer (F.Buffer) at 2×100 ug/mouse. The mice were bled at 13 hours after the intramuscular injection to determine the concentration of human the polypeptide in serum in pg/mL. The results revealed that administration of Factor IX mmRNA resulted in levels of 1600 pg/mL at 13 hours as compared to less than 100 pg/mL of Factor IX for either Luciferase or buffer control administration.

Example 51

Multi-Site Administration: Intramuscular and Subcutaneous

Human G-CSF modified mRNA (mRNA sequence shown in SEQ ID NO: 33897; polyA tail of approximately 160 nucleotides not shown in sequence; 5'cap, Cap1) modified as either Gen1 or Gen2 (5-methylcytosine (5mc) and a pseudouridine (ψ) modification, G-CSF-Gen1; or N1-5-methylcytosine (N1-5mc) and a ψ modification, G-CSF-Gen2) and formulated in formulation buffer were delivered to mice via intramuscular (IM) or subcutaneous (SC) injection. Injection of four doses or 2×50 ug (two sites) daily for three days (24 hrs interval) was performed. The fourth dose was administered 6 hrs before blood collection and CBC analysis. Controls included Luciferase (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) or the formulation buffer (F.Buffer). The mice were bled at 72 hours after the first mRNA injection (6 hours after the last modified mRNA dose) to determine the effect of mRNA-encoded human G-CSF on the neutrophil count. The dosing regimen is shown in Table 70 as are the resulting neutrophil counts (thousands/uL). In Table 70, an asterisk (*) indicates statistical significance at p<0.05. For intramuscular administration, the data reveal a four fold increase in neutrophil count above control at day 3 for the Gen1 G-CSF mRNA and a two fold increase for the Gen2 G-CSF mmRNA. For subcutaneous administration, the data reveal a two fold increase in neutrophil count above control at day 3 for the Gen2 G-CSF mRNA.

These data demonstrate that both 5-methylcytidine/pseudouridine and 5-methylcytidine/N1-methylpseudouridine-modified mRNA can be biologically active, as evidenced by specific increases in blood neutrophil counts.

TABLE 70

Dosing Regimen

| Gr. | Treatment | Route | N= | Dose (µg/mouse) | Dose Vol. (µl/mouse) | Dosing Vehicle | Neutrophil Thous/uL |
|---|---|---|---|---|---|---|---|
| 1 | G-CSF (Gen1) | I.M | 5 | 2 × 50 ug (four doses) | 50 | F. buffer | 840* |
| 2 | G-CSF (Gen1) | S.C | 5 | 2 × 50 ug (four doses) | 50 | F. buffer | 430 |
| 3 | G-CSF (Gen2) | I.M | 5 | 2 × 50 ug (four doses) | 50 | F. buffer | 746* |
| 4 | G-CSF (Gen2) | S.C | 5 | 2 × 50 ug (four doses) | 50 | F. buffer | 683 |
| 5 | Luc (Gen1) | I.M. | 5 | 2 × 50 ug (four doses) | 50 | F. buffer | 201 |
| 6 | Luc (Gen1) | S.C. | 5 | 2 × 50 ug (four doses) | 50 | F. buffer | 307 |
| 7 | Luc (Gen2) | I.M | 5 | 2 × 50 ug (four doses) | 50 | F. buffer | 336 |
| 8 | Luc (Gen2) | S.C | 5 | 2 × 50 ug (four doses) | 50 | F. buffer | 357 |
| 9 | F. Buffer | I.M | 4 | 0 (four doses) | 50 | F. buffer | 245 |
| 10 | F. Buffer | S.C. | 4 | 0 (four doses) | 50 | F. buffer | 509 |
| 11 | Untreated | — | 4 | | | — | 312 |

Example 52

Intravenous Administration

Human G-CSF modified mRNA (mRNA sequence shown in SEQ ID NO: 33897; polyA tail of approximately 160 nucleotides not shown in sequence; 5'cap, Cap1) modified with 5-methylcytosine (5mc) and a pseudouridine (ψ) modification (Gen1); or having no modifications and formulated in 10% lipoplex (RNAiMax) were delivered to mice at a dose of 50 ug RNA and in a volume of 100 ul via intravenous (IV) injection at days 0, 2 and 4. Neutrophils were measured at days 1, 5 and 8. Controls included non-specific mammalian RNA or the formulation buffer alone (F.Buffer). The mice were bled at days 1, 5 and 8 to determine the effect of modified mRNA-encoded human G-CSF to increase neutrophil count. The dosing regimen is shown in Table 71 as are the resulting neutrophil counts (thousands/uL; K/uL).

For intravenous administration, the data reveal a four to five fold increase in neutrophil count above control at day 5 with G-CSF modified mRNA but not with unmodified G-CSF mRNA or non-specific controls. Blood count returned to baseline four days after the final injection. No other changes in leukocyte populations were observed. In Table 71, an asterisk (*) indicates statistical significance at p<0.001 compared to buffer.

These data demonstrate that lipoplex-formulated 5-methylcytidine/pseudouridine-modified mRNA can be biologically active, when delivered through an I.V. route of administration as evidenced by specific increases in blood neutrophil counts. No other cell subsets were significantly altered. Unmodified G-CSF mRNA similarly administered showed no pharmacologic effect on neutrophil counts.

TABLE 71

Dosing Regimen

| Gr. | Day | Treatment | N= | Dose Vol. (μl/mouse) | Dosing Vehicle | Neutrophil K/uL |
|---|---|---|---|---|---|---|
| 1 | 1 | G-CSF (Gen1) | 5 | 100 | 10% lipoplex | 2.91 |
| 2 | 5 | G-CSF (Gen1) | 5 | 100 | 10% lipoplex | 5.32* |
| 3 | 8 | G-CSF (Gen1) | 5 | 100 | 10% lipoplex | 2.06 |
| 4 | 1 | G-CSF (no modification) | 5 | 100 | 10% lipoplex | 1.88 |
| 5 | 5 | G-CSF (no modification) | 5 | 100 | 10% lipoplex | 1.95 |
| 6 | 8 | G-CSF (no modification) | 5 | 100 | 10% lipoplex | 2.09 |
| 7 | 1 | RNA control | 5 | 100 | 10% lipoplex | 2.90 |
| 8 | 5 | RNA control | 5 | 100 | 10% lipoplex | 1.68 |
| 9 | 8 | RNA control | 4 | 100 | 10% lipoplex | 1.72 |
| 10 | 1 | F. Buffer | 4 | 100 | 10% lipoplex | 2.51 |
| 11 | 5 | F. Buffer | 4 | 100 | 10% lipoplex | 1.31 |
| 12 | 8 | F. Buffer | 4 | 100 | 10% lipoplex | 1.92 |

Example 53

Saline Formulation: Intramuscular Administration

A. Protein Production

Human G-CSF modified mRNA (mRNA sequence shown in SEQ ID NO: 33897; polyA tail of approximately 160 nucleotides not shown in sequence; 5'cap, Cap1) and human EPO mmRNA (mRNA sequence shown in SEQ ID NO: 33900; polyA tail of approximately 160 nucleotides not shown in sequence; 5'cap, Cap1); G-CSF modified mRNA (modified with 5-methylcytosine (5mc) and pseudouridine (ψ)) and EPO modified mRNA (modified with N1-5-methylcytosine (N1-5mc) and ψ modification), were formulated in formulation buffer (150 mM sodium chloride, 2 mM calcium chloride, 2 mM phosphate, 0.5 mM EDTA at a pH of 6.5) and delivered to mice via intramuscular (IM) injection at a dose of 100 ug.

Controls included Luciferase (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) or the formulation buffer (F.Buffer). The mice were bled at 13 hours after the injection to determine the concentration of the human polypeptide in serum in pg/mL. (G-CSF groups measured human G-CSF in mouse serum and EPO groups measured human EPO in mouse serum). The data are shown in Table 72.

TABLE 72

Dosing Regimen

| Group | Treatment | N= | Dose Vol. (μl/mouse) | Dosing Vehicle | Average Protein Product pg/mL, serum |
|---|---|---|---|---|---|
| G-CSF | G-CSF | 5 | 50 | Saline | 19.8 |
| G-CSF | Luciferase | 5 | 50 | Saline | 0.5 |
| G-CSF | F. buffer | 5 | 50 | F. buffer | 0.5 |
| EPO | EPO | 5 | 50 | Saline | 191.5 |
| EPO | Luciferase | 5 | 50 | Saline | 15.0 |
| EPO | F. buffer | | | F. buffer | 4.8 |

B. Dose Response

Human EPO modified mRNA (mRNA sequence shown in SEQ ID NO: 33900; polyA tail of approximately 160 nucleotides not shown in sequence; 5'cap, Cap1; fully modified with 5-methylcytosine and pseudouridine) were formulated in formulation buffer and delivered to mice via intramuscular (IM) injection.

Controls included Luciferase (mRNA sequence shown in SEQ ID NO: 33906, polyA tail of approximately 160 nucleotides not shown in sequence, 5'cap, Cap1, fully modified with 5-methylcytosine and pseudouridine) or the formulation buffer (F.Buffer). The mice were bled at 13 hours after the injection to determine the concentration of the human polypeptide in serum in pg/mL. The dose and expression are shown in Table 73.

TABLE 73

Dosing Regimen and Expression

| Treatment | Dose Vol. (μl/mouse) | Average Protein Product pg/mL, serum |
|---|---|---|
| EPO | 100 | 96.2 |
| EPO | 50 | 63.5 |
| EPO | 25 | 18.7 |
| EPO | 10 | 25.9 |
| EPO | 1 | 2.6 |
| Luciferase | 100 | 0.0 |
| F. buffer | 100 | 1.0 |

Example 54

EPO Multi-Dose/Multi-Administration

Studies utilizing multiple intramuscular injection sites at one time point were designed and performed.

The design of a single multi-dose experiment involved using human erythropoietin (EPO) mmRNA (mRNA sequence shown in SEQ ID NO: 33900; polyA tail of approximately 160 nucleotides not shown in sequence; 5'cap, Cap1) or G-CSF mmRNA (mRNA sequence shown in SEQ ID NO: 33897; polyA tail of approximately 160 nucleotides not shown in sequence; 5'cap, Cap1) administered in formulation buffer. The dosing vehicle (F. buffer) was used as a control. The EPO and G-CSF modified mRNA were modified with 5-methylcytosine at each cytosine and pseudouridine replacement at each uridine site.

Animals (n=5), Sprague-Dawley rats, were injected IM (intramuscular) for the single unit dose of 100 ug (delivered to one thigh). For multi-dosing 6 doses of 100 ug (delivered to two thighs) were used for both EPO and G-CSF mmRNA. Control dosing involved use of buffer at a single dose. Human EPO blood levels were evaluated 13 hrs post injection.

Human EPO protein was measured in rat serum 13 hrs post intramuscular injection. Five groups of rats were treated and evaluated. The results are shown in Table 74.

TABLE 74

Multi-dose study

| Group | Treatment | Dose of mmRNA | Total Dose | Avg. Pg/mL human EPO, serum |
|---|---|---|---|---|
| 1 | Human EPO mmRNA | 1 × 100 ug | 100 ug | 143 |
| 2 | Human EPO mmRNA | 6 × 100 ug | 600 ug | 256 |
| 3 | G-CSF mmRNA | 1 × 100 ug | 100 ug | 43 |
| 4 | G-CSF mmRNA | 6 × 100 ug | 600 ug | 58 |
| 5 | Buffer Alone | — | — | 20 |

Example 55

Signal Sequence Exchange Study

Several variants of mmRNAs encoding human Granulocyte colony stimulating factor (G-CSF) (mRNA sequence shown in SEQ ID NO: 33897; polyA tail of approximately 160 nucleotides not shown in sequence; 5'cap, Cap1) were synthesized using modified nucleotides pseudouridine and 5-methylcytosine (pseudo-U/5mC). These variants included the G-CSF constructs encoding either the wild-type N terminal secretory signal peptide sequence (MAGPATQSPMKL-MALQLLLWHSALWTVQEA; SEQ ID NO: 95), no secretory signal peptide sequence, or secretory signal peptide sequences taken from other mRNAs. These included sequences where the wild type G-CSF signal peptide sequence was replaced with the signal peptide sequence of either: human α-1-anti trypsin (AAT) (MMPSS-VSWGILLLAGLCCLVPVSLA; SEQ ID NO: 94), human Factor IX (FIX) (MQRVNMIMAESPSLITICLLGYLL-SAECTVFLDHENANKILNRPKR; SEQ ID NO: 96), human Prolactin (Prolac) (MKGSLLLLLVSNLLLCQS-VAP; SEQ ID NO: 97), or human Albumin (Alb) (MKWVT-FISLLFLFSSAYSRGVFRR; SEQ ID NO: 98).

250 ng of modified mRNA encoding each G-CSF variant was transfected into HEK293A (293A in the table), mouse myoblast (MM in the table) (C2C12, CRL-1772, ATCC) and rat myoblast (RM in the table) (L6 line, CRL-1458, ATCC) cell lines in a 24 well plate using 1 ul of Lipofectamine 2000 (Life Technologies), each well containing 300,000 cells. The supernatants were harvested after 24 hrs and the secreted G-CSF protein was analyzed by ELISA using the Human G-CSF ELISA kit (Life Technologies). The data shown in Table 75 reveal that cells transfected with G-CSF mmRNA encoding the Albumin signal peptide secrete at least 12 fold more G-CSF protein than its wild type counterpart.

TABLE 75

Signal Peptide Exchange

| Signal peptides | 293A (pg/ml) | MM (pg/ml) | RM (pg/ml) |
|---|---|---|---|
| G-CSF Natural | 9650 | 3450 | 6050 |
| α-1-anti trypsin | 9950 | 5000 | 8475 |
| Factor IX | 11675 | 6175 | 11675 |
| Prolactin | 7875 | 1525 | 9800 |
| Albumin | 122050 | 81050 | 173300 |
| No Signal peptide | 0 | 0 | 0 |

Example 56

Cytokine Study: PBMC

A. PBMC Isolation and Culture 50 mL of human blood from two donors was received from Research Blood Components (lots KP30928 and KP30931) in sodium heparin tubes. For each donor, the blood was pooled and diluted to 70 mL with DPBS (SAFC Bioscience 59331C, lot 071M8408) and split evenly between two 50 mL conical tubes. 10 mL of Ficoll Paque (GE Healthcare 17-5442-03, lot 10074400) was gently dispensed below the blood layer. The tubes were centrifuged at 2000 rpm for 30 minutes with low acceleration and braking. The tubes were removed and the buffy coat PBMC layers were gently transferred to a fresh 50 mL conical and washed with DPBS. The tubes were centrifuged at 1450 rpm for 10 minutes.

The supernatant was aspirated and the PBMC pellets were resuspended and washed in 50 mL of DPBS. The tubes were centrifuged at 1250 rpm for 10 minutes. This wash step was repeated, and the PBMC pellets were resuspended in 19 mL of Optimem I (Gibco 11058, lot 1072088) and counted. The cell suspensions were adjusted to a concentration of $3.0 \times 10^6$ cells/mL live cells.

These cells were then plated on five 96 well tissue culture treated round bottom plates (Costar 3799) per donor at 50 uL per well. Within 30 minutes, transfection mixtures were added to each well at a volume of 50 uL per well. After 4 hours post transfection, the media was supplemented with 10 uL of Fetal Bovine Serum (Gibco 10082, lot 1012368)

B. Transfection Preparation mmRNA encoding human G-CSF (mRNA sequence shown in SEQ ID NO: 33897; polyA tail of approximately 160 nucleotides not shown in sequence; 5'cap, Cap1) (containing either (1) natural NTPs, (2) 100% substitution with 5-methyl cytidine and pseudouridine, or (3) 100% substitution with 5-methyl cytidine and N1-methyl pseudouridine; mmRNA encoding luciferase (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) (containing either (1) natural NTPs or (2) 100% substitution with 5-methyl cytidine and pseudouridine) and TLR agonist R848 (Invivogen tlrl-r848) were diluted to 38.4 ng/uL in a final volume of 2500 uL Optimem I.

Separately, 432 uL of Lipofectamine 2000 (Invitrogen 11668-027, lot 1070962) was diluted with 13.1 mL Optimem I. In a 96 well plate nine aliquots of 135 uL of each mmRNA, positive control (R-848) or negative control (Optimem I) was added to 135 uL of the diluted Lipofectamine 2000. The plate containing the material to be transfected was incubated for 20 minutes. The transfection mixtures were then transferred to each of the human PBMC plates at 50 uL per well. The plates were then incubated at 37 C. At 2, 4, 8, 20, and 44 hours each plate was removed from the incubator, and the supernatants were frozen.

After the last plate was removed, the supernatants were assayed using a human G-CSF ELISA kit (Invitrogen KHC2032) and human IFN-alpha ELISA kit (Thermo Scientific 41105-2). Each condition was done in duplicate.

C. Results

The ability of unmodified and modified mRNA (mmRNAs) to produce the encoded protein was assessed (G-CSF production) over time as was the ability of the mRNA to trigger innate immune recognition as measured by interferon-alpha production. Use of in vitro PBMC cultures is an accepted way to measure the immunostimulatory potential of oligonucleotides (Robbins et al., Oligonucleotides 2009 19:89-102; herein incorporated by reference in its entirety).

Results were interpolated against the standard curve of each ELISA plate using a four parameter logistic curve fit. Shown in Tables 76 and 77 are the average from 2 separate PBMC donors of the G-CSF and IFN-alpha production over time as measured by specific ELISA.

In the G-CSF ELISA, background signal from the Lipofectamine 2000 untreated condition was subtracted at each timepoint. The data demonstrated specific production of human G-CSF protein by human peripheral blood mononuclear is seen with G-CSF mRNA containing natural NTPs, 100% substitution with 5-methyl cytidine and pseudouridine, or 100% substitution with 5-methyl cytidine and N1-methyl-pseudouridine. Production of G-CSF was significantly increased through the use of modified mRNA relative to unmodified mRNA, with the 5-methyl cytidine and N1-methyl-pseudouridine containing G-CSF mmRNA showing the highest level of G-CSF production. With regards to innate immune recognition, unmodified mRNA resulted in substantial IFN-alpha production, while the modified mRNA largely prevented interferon-alpha production. G-CSF mRNA fully modified with 5-methyl cytidine and N1-methyl-pseudouridine did not significantly increase cytokines whereas G-CSF mRNA fully modified with 5-methyl cytidine and pseudouridine induced IFN-alpha, TNF-alpha and IP10. Many other cytokines were not affected by either modification.

TABLE 76

G-CSF Signal
G-CSF signal - 2 Donor Average

| pg/mL | 2 Hr | 4 Hr | 8 Hr | 20 Hr | 44 Hr |
|---|---|---|---|---|---|
| G-CSF (5mC/pseudouridine) | 120.3 | 136.8 | 421.0 | 346.1 | 431.8 |
| G-CSF (5mC/N1-methyl pseudouridine) | 256.3 | 273.7 | 919.3 | 1603.3 | 1843.3 |
| G-CSF(Natural-no modification) | 63.5 | 92.6 | 129.6 | 258.3 | 242.4 |
| Luciferase (5mC/pseudouridine) | 4.5 | 153.7 | 33.0 | 186.5 | 58.0 |

TABLE 77

IFN-alpha signal
IFN-alpha signal - 2 donor average

| pg/mL | 2 Hr | 4 Hr | 8 Hr | 20 Hr | 44 Hr |
|---|---|---|---|---|---|
| G-CSF (5mC/pseudouridine) | 21.1 | 2.9 | 3.7 | 22.7 | 4.3 |
| G-CSF (5mC/N1-methyl pseudouridine) | 0.5 | 0.4 | 3.0 | 2.3 | 2.1 |
| G-CSF(Natural) | 0.0 | 2.1 | 23.3 | 74.9 | 119.7 |
| Luciferase (5mC/pseudouridine) | 0.4 | 0.4 | 4.7 | 1.0 | 2.4 |
| R-848 | 39.1 | 151.3 | 278.4 | 362.2 | 208.1 |
| Lpf. 2000 control | 0.8 | 17.2 | 16.5 | 0.7 | 3.1 |

Example 57

Chemical Modification Ranges of Modified mRNA

Modified nucleotides such as, but not limited to, the chemical modifications 5-methylcytosine and pseudouridine have been shown to lower the innate immune response and increase expression of RNA in mammalian cells. Surprisingly, and not previously known, the effects manifested by the chemical modifications can be titrated when the amount of chemical modification is less than 100%. Previously, it was believed that full modification was necessary and sufficient to elicit the beneficial effects of the chemical modifications and that less than 100% modification of an mRNA had little effect. However, it has now been shown that the benefits of chemical modification can be derived using less than complete modification and that the effects are target, concentration and modification dependent.

A. Modified RNA Transfected in PBMC 960 ng of G-CSF mRNA modified with 5-methylcytosine (5mC) and pseudouridine (pseudoU) or unmodified G-CSF mRNA was transfected with 0.8 uL of Lipofectamine 2000 into peripheral blood mononuclear cells (PBMC) from three normal blood donors (D1, D2, D3). The G-CSF mRNA (mRNA sequence shown in SEQ ID NO: 33897; polyA tail of approximately 160 nucleotides not shown in sequence; 5'cap, Cap1) was completely modified with 5mC and pseudoU (100% modification), not modified with 5mC and pseudoU (0% modification) or was partially modified with 5mC and pseudoU so the mRNA would contain 50% modification, 25% modification, 10% modification, %5 modification, 1% modification or 0.1% modification. A control sample of Luciferase (mRNA sequence shown in SEQ ID NO: 33907; polyA tail of approximately 160 nucleotides not shown in sequence; 5'cap, Cap1; fully modified 5meC and pseudoU) was also analyzed for G-CSF expression. For TNF-alpha and IFN-alpha control samples of Lipofectamine2000, LPS, R-848, Luciferase (mRNA sequence shown in SEQ ID NO: 33907; polyA tail of approximately 160 nucleotides not shown in sequence; 5'cap, Cap1; fully modified 5mC and pseudo), and P(I)P(C) were also analyzed. The supernatant was harvested and run by ELISA 22 hours after transfection to determine the protein expression. The expression of G-CSF is shown in Table 78 and the expression of IFN-alpha and TNF-alpha is shown in Table 79. The expression of IFN-alpha and TNF-alpha may be a secondary effect from the transfection of the G-CSF mRNA. Tables 78 and 79 show that the amount of chemical modification of G-CSF, IFN-alpha and TNF-alpha is titratable when the mRNA is not fully modified and the titratable trend is not the same for each target.

TABLE 78

G-CSF Expression

| | G-CSF Expression (pg/ml) | | |
|---|---|---|---|
| | D1 | D2 | D3 |
| 100% modification | 270.3 | 151.6 | 162.2 |
| 50% modification | 45.6 | 19.8 | 26.3 |
| 25% modification | 23.6 | 10.8 | 8.9 |
| 10% modification | 39.4 | 12.9 | 12.9 |
| 5% modification | 70.9 | 26.8 | 26.3 |
| 1% modification | 70.3 | 26.9 | 66.9 |
| 0.1% modification | 67.5 | 25.2 | 28.7 |
| Luciferase | 14.5 | 3.1 | 10.0 |

TABLE 79

IFN-alpha and TNF-alpha Expression

| | IFN-alpha Expression (pg/ml) | | | TNF-alpha Expression (pg/ml) | | |
|---|---|---|---|---|---|---|
| | D1 | D2 | D3 | D1 | D2 | D3 |
| 100% modification | 76.8 | 6.8 | 15.1 | 5.6 | 1.4 | 21.4 |
| 50% modification | 22.0 | 5.5 | 257.3 | 4.7 | 1.7 | 12.1 |
| 25% modification | 64.1 | 14.9 | 549.7 | 3.9 | 0.7 | 10.1 |
| 10% modification | 150.2 | 18.8 | 787.8 | 6.6 | 0.9 | 13.4 |
| 5% modification | 143.9 | 41.3 | 1009.6 | 2.5 | 1.8 | 12.0 |
| 1% modification | 189.1 | 40.5 | 375.2 | 9.1 | 1.2 | 25.7 |
| 0.1% modification | 261.2 | 37.8 | 392.8 | 9.0 | 2. | 13.7 |
| 0% modification | 230.3 | 45.1 | 558.3 | 10.9 | 1.4 | 10.9 |
| LF 200 | 0 | 0 | 1.5 | 45.8 | 2.8 | 53.6 |
| LPS | 0 | 0 | 1.0 | 114.5 | 70.0 | 227.0 |
| R-848 | 39.5 | 11.9 | 183.5 | 389.3 | 256.6 | 410.6 |
| Luciferase | 9.1 | 0 | 3.9 | 4.5 | 2.7 | 13.6 |
| P(I)P(C) | 1498.1 | 216.8 | 238.8 | 61.2 | 4.4 | 69.1 |

B. Modified RNA Transfected in HEK293

Human embryonic kidney epithelial (HEK293) cells were seeded on 96-well plates at a density of 30,000 cells per well in 100 ul cell culture medium. 250 ng of modified G-CSF mRNA (mRNA sequence shown in SEQ ID NO: 33897; polyA tail of approximately 160 nucleotides not shown in sequence; 5'cap, Cap1) formulated with RNAiMAX™ (Invitrogen, Carlsbad, Calif.) was added to a well. The G-CSF was completely modified with 5mC and pseudoU (100% modification), not modified with 5mC and pseudoU (0% modification) or was partially modified with 5mC and pseudoU so the mRNA would contain 75% modification, 50% modification or 25% modification. Control samples (AK 5/2, mCherry (SEQ ID NO: 33898; polyA tail of approximately 160 nucleotides not shown in sequence; 5'cap, Cap1; fully modified 5mC and pseudoU) and untreated) were also analyzed. The half-life of G-CSF mRNA fully modified with 5-methylcytosine and pseudouridine is approximately 8-10 hours. The supernatants were harvested after 16 hours and the secreted G-CSF protein was analyzed by ELISA. Table 80 shows that the amount of chemical modification of G-CSF is titratable when the mRNA is not fully modified.

TABLE 80

G-CSF Expression

| | G-CSF Expression (ng/ml) |
|---|---|
| 100% modification | 118.4 |
| 75% modification | 101.9 |
| 50% modification | 105.7 |
| 25% modification | 231.1 |
| 0% modification | 270.9 |
| AK 5/2 | 166.8 |
| mCherry | 0 |
| Untreated | 0 |

Example 58

In Vivo Delivery of Modified mRNA (mmRNA)

Modified RNA was delivered to C57/BL6 mice intramuscularly, subcutaneously, or intravenously to evaluate the biodistribution of modified RNA using luciferase. A formulation buffer used with all delivery methods contained 150 mM sodium chloride, 2 mM calcium chloride, 2 mM Na+-phosphate which included 1.4 mM monobasic sodium phosphate and 0.6 mM of dibasic sodium phosphate, and 0.5 mM ethylenediaminetetraacetic acid (EDTA) was adjusted using sodium hydroxide to reach a final pH of 6.5 before being filtered and sterilized. A 1× concentration was used as the delivery buffer. To create the lipoplexed solution delivered to the mice, in one vial 50 µg of RNA was equilibrated for 10 minutes at room temperature in the delivery buffer and in a second vial 10 µl RNAiMAX™ was equilibrated for 10 minutes at room temperature in the delivery buffer. After equilibrium, the vials were combined and delivery buffer was added to reach a final volume of 100 µl which was then incubated for 20 minutes at room temperature. Luciferin was administered by intraperitoneal injection (IP) at 150 mg/kg to each mouse prior to imaging during the plateau phase of the luciferin exposure curve which was between 15 and 30 minutes. To create luciferin, 1 g of D-luciferin potassium or sodium salt was dissolved in 66.6 ml of distilled phosphate buffer solution (DPBS), not containing Mg2+ or Ca2+, to make a 15 mg/ml solution. The solution was gently mixed and passed through a 0.2 µm syringe filter, before being purged with nitrogen, aliquoted and frozen at −80° C. while being protected from light as much as possible. The solution was thawed using a waterbath if luciferin was not dissolved, gently mixed and kept on ice on the day of dosing.

Whole body images were taken of each mouse 2, 8 and 24 hours after dosing. Tissue images and serum was collected from each mouse 24 hours after dosing. Mice administered doses intravenously had their liver, spleen, kidneys, lungs, heart, peri-renal adipose tissue and thymus imaged. Mice administered doses intramuscularly or subcutaneously had their liver, spleen, kidneys, lungs, peri-renal adipose tissue, and muscle at the injection site. From the whole body images the bioluminescence was measured in photon per second for each route of administration and dosing regimen.

A. Intramuscular Administration

Mice were intramuscularly (I.M.) administered either modified luciferase mRNA fully modified with 5-methylcytosine and pseudouridine (Naked-Luc), lipoplexed modified luciferase mRNA fully modified with 5-methylcytosine and pseudouridine (Lipoplex-luc) (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site), lipoplexed modified granulocyte colony-stimulating factor (G-CSF) mRNA (mRNA sequence shown in SEQ ID NO: 33897; polyA tail of approximately 160 nucleotides not shown in sequence; 5'cap, Cap1; fully modified with 5-methylcytosine and pseudouridine) (Lipoplex-Cytokine) or the formation buffer at a single dose of 50 μg of modified RNA in an injection volume of 50 μl for each formulation in the right hind limb and a single dose of 5 μg of modified RNA in an injection volume of 50 μl in the left hind limb. The bioluminescence average for the luciferase expression signals for each group at 2, 8 and 24 hours after dosing are shown Table 81. The bioluminescence showed a positive signal at the injection site of the 5 μg and 50 μg modified RNA formulations containing and not containing lipoplex.

TABLE 81

In vivo Biophotoic Imaging (I.M. Injection Route)

| Formulation | Dose (ug) | Bioluminescence (photon/sec) | | |
|---|---|---|---|---|
| | | 2 hours | 8 hours | 24 hours |
| Naked-Luc | 5 | 224,000 | 683,000 | 927,000 |
| Lipolplex-Luc | 5 | 579,000 | 639,000 | 186,000 |
| Lipoplex-G-CSF | 5 | 64,600 | 85,600 | 75,100 |
| Formulation Buffer | 5 | 102,000 | 86,000 | 90,700 |
| Naked-Luc | 50 | 446,000 | 766,000 | 509,000 |
| Lipolplex-Luc | 50 | 374,000 | 501,000 | 332,000 |
| Lipoplex-G-CSF | 50 | 49,400 | 74,800 | 74,200 |
| Formulation Buffer | 50 | 59,300 | 69,200 | 63,600 |

B. Subcutaneous Administration

Mice were subcutaneously (S.C.) administered either modified luciferase mRNA (Naked-Luc), lipoplexed modified luciferase mRNA (Lipoplex-luc), lipoplexed modified G-CSF mRNA (Lipoplex-G-CSF) or the formation buffer at a single dose of 50 μg of modified mRNA in an injection volume of 100 μl for each formulation. The bioluminescence average for the luciferase expression signals for each group at 2, 8 and 24 hours after dosing are shown in Table 82. The bioluminescence showed a positive signal at the injection site of the 50 μg modified mRNA formulations containing and not containing lipoplex.

TABLE 82

In vivo Biophotoic Imaging (S.C. Injection Route)

| Formulation | Bioluminescence (photon/sec) | | |
|---|---|---|---|
| | 2 hours | 8 hours | 24 hours |
| Naked-Luc | 3,700,000 | 8,060,000 | 2,080,000 |
| Lipolplex-Luc | 3,960,000 | 1,700,000 | 1,290,000 |
| Lipoplex-G-CSF | 123,000 | 121,000 | 117,000 |
| Formulation Buffer | 116,000 | 127,000 | 123,000 |

C. Intravenous Administration

Mice were intravenously (I.V.) administered either modified luciferase mRNA (Naked-Luc), lipoplexed modified luciferase mRNA (Lipoplex-luc), lipoplexed modified G-CSF mRNA (Lipoplex-G-CSF) or the formation buffer at a single dose of 50 μg of modified mRNA in an injection volume of 100 μl for each formulation. The bioluminescence average for the luciferase expression signal in the spleen from each group at 2 hours after dosing is shown in Table 83. The bioluminescence showed a positive signal in the spleen of the 50 μg modified mRNA formulations containing lipoplex.

TABLE 83

In vivo Biophotoic Imaging (I.V. Injection Route)

| Formulation | Bioluminescence (photon/sec) of the Spleen |
|---|---|
| Naked-Luc | 58,400 |
| Lipolplex-Luc | 65,000 |
| Lipoplex-G-CSF | 57,100 |
| Formulation Buffer | 58,300 |

Example 59

Buffer Formulation Studies

G-CSF modified mRNA (mRNA sequence shown in SEQ ID NO: 33897; polyA tail of approximately 160 nucleotides not shown in sequence; 5'cap, Cap1; fully modified with N1-pseudouridine and 5-methylcytosine) or Factor IX modified mRNA (mRNA sequence shown in SEQ ID NO: 33901; polyA tail of approximately 160 nucleotides not shown in sequence; 5'cap, Cap1; fully modified with N1-pseudouridine and 5-methylcytosine) in a buffer solution is administered intramuscularly to rats in an injection volume of 50 μl (n=5) at a modified mRNA dose of 200 ug per rat as described in Table 84. The modified mRNA is lyophilized in water for 1-2 days. It is then reconstituted in the buffers listed below to a target concentration of 6 mg/ml. Concentration is determined by OD 260. Samples are diluted to 4 mg/ml in the appropriate buffer before dosing.

To precipitate the modified mRNA, 3M sodium acetate, pH 5.5 and pure ethanol are added at $\frac{1}{10}^{th}$ the total volume and 4 times the total volume of modified mRNA, respectively. The material is placed at −80 C for a minimum of 1 hour. The material is then centrifuged for 30 minutes at 4000 rpm, 4 C. The supernatant is removed and the pellet is centrifuged and washed 3× with 75% ethanol. Finally, the pellet is reconstituted with buffer to a target concentration of 6 mg/ml. Concentration is determined by OD 260. Samples are diluted to 4 mg/ml in the appropriate buffer before dosing. All samples are prepared by lyophilization unless noted below.

TABLE 84

Buffer Dosing Groups

| Group | Treatment | Buffer | Dose (ug/rat) |
|---|---|---|---|
| 1 | G-CSF | 0.9% Saline | 200 |
| | Factor IX | 0.9% Saline | 200 |
| 2 | G-CSF | 0.9% Saline + 2 mM Calcium | 200 |
| | Factor IX | 0.9% Saline + 2 mM Calcium | 200 |
| 3 | G-CSF | Lactated Ringer's | 200 |
| | Factor IX | Lactated Ringer's | 200 |
| 4 | G-CSF | 5% Sucrose | 200 |
| | Factor IX | 5% Sucrose | 200 |
| 5 | G-CSF | 5% Sucrose + 2 mM Calcium | 200 |
| | Factor IX | 5% Sucrose + 2 mM Calcium | 200 |
| 6 | G-CSF | 5% Mannitol | 200 |
| | Factor IX | 5% Mannitol | 200 |
| 7 | G-CSF | 5% Mannitol + 2 mM Calcium | 200 |
| | Factor IX | 5% Mannitol + 2 mM Calcium | 200 |
| 8 | G-CSF | 0.9% saline (precipitation) | 200 |
| | Factor IX | 0.9% saline (precipitation) | 200 |

Serum samples are collected from the rats at various time intervals and analyzed for G-CSF or Factor IX protein expression using G-CSF or Factor IX ELISA.

Example 60

Multi-Dose Study

Sprague-Dawley rats (n=8) are injected intravenously eight times (twice a week) over 28 days. The rats are injected with 0.5 mg/kg, 0.05 mg/kg, 0.005 mg/kg or 0.0005 mg/kg of human G-CSF modified mRNA of luciferase modified mRNA formulated in a lipid nanoparticle, 0.5 mg/kg of human G-CSF modified mRNA in saline, 0.2 mg/kg of the human G-CSF protein Neupogen or non-translatable human G-CSF modified mRNA formulated in a lipid nanoparticle. Serum is collected during predetermined time intervals to evaluate G-CSF protein expression (8, 24 and 72 hours after the first dose of the week), complete blood count and white blood count (24 and 72 hours after the first dose of the week) and clinical chemistry (24 and 72 hours after the first dose of the week). The rats are sacrificed at day 29, 4 days after the final dosing, to determine the complete blood count, white blood count, clinical chemistry, protein expression and to evaluate the effect on the major organs by histopathology and necropsy. Further, an antibody assay is performed on the rats on day 29.

Example 61

LNP In Vivo Study

Luciferase modified mRNA (mRNA sequence shown in SEQ ID NO: 33907; polyA tail of approximately 160 nucleotides not shown in sequence, 5'cap, Cap1; fully modified with 5-methylcytosine and pseudouridine was formulated as a lipid nanoparticle (LNP) using the syringe pump method. The LNP was formulated at a 20:1 weight ratio of total lipid to modified mRNA with a final lipid molar ratio of 50:10:38.5:1.5 (DLin-KC2-DMA: DSPC: Cholesterol: PEG-DMG). As shown in Table 85, the luciferase LNP formulation was characterized by particle size, zeta potential, and encapsulation.

TABLE 85

Luciferase Formulation

| Formulation | NPA-098-1 |
|---|---|
| Modified mRNA | Luciferase |
| Mean size | 135 nm |
| | PDI: 0.08 |

TABLE 85-continued

Luciferase Formulation

| Zeta at pH 7.4 | −0.6 mV |
|---|---|
| Encaps. (RiboGr) | 91% |

As outlined in Table 86, the luciferase LNP formulation was administered to Balb-C mice (n=3) intramuscularly, intravenously and subcutaneously and a luciferase modified RNA formulated in PBS was administered to mice intravenously.

TABLE 86

Luciferase Formulations

| Formulation | Vehicle | Route | Concentration (mg/ml) | Injection Volume (ul) | Amount of modified RNA (ug) | Dose (mg/kg) |
|---|---|---|---|---|---|---|
| Luc-LNP | PBS | IV | 0.20 | 50 | 10 | 0.50 |
| Luc-LNP | PBS | IM | 0.20 | 50 | 10 | 0.50 |
| Luc-LNP | PBS | SC | 0.20 | 50 | 10 | 0.50 |
| Luc-PBS | PBS | IV | 0.20 | 50 | 10 | 0.50 |

The mice administered the luciferase LNP formulation intravenously and intramuscularly were imaged at 2, 8, 24, 48, 120 and 192 hours and the mice administered the luciferase LNP formulation subcutaneously were imaged at 2, 8, 24, 48 and 120 hours to determine the luciferase expression as shown in Table 87. In Table 87, "NT" means not tested. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse.

TABLE 87

Luciferase Expression

| Formulation | Route of Administration | Average Expression (photon/second) | | | | | |
|---|---|---|---|---|---|---|---|
| | | 2 hours | 8 hours | 24 hours | 48 hours | 120 hours | 192 hours |
| Luc-LNP | IV | 1.62E+08 | 3.00E+09 | 7.77E+08 | 4.98E+08 | 1.89E+08 | 6.08E+07 |
| Luc-LNP | IM | 4.85E+07 | 4.92E+08 | 9.02E+07 | 3.17E+07 | 1.22E+07 | 2.38E+06 |
| Luc-LNP | SC | 1.85E+07 | 9.79E+08 | 3.09E+08 | 4.94E+07 | 1.98E+06 | NT |
| Luc-PBS | IV | 3.61E+05 | 5.64E+05 | 3.19E+05 | NT | NT | NT |

One mouse administered the LNP formulation intravenously was sacrificed at 8 hours to determine the luciferase expression in the liver and spleen. Also, one mouse administered the LNP formulation intramuscular was sacrificed at 8 hours to determine the luciferase expression of the muscle around the injection site and in the liver and spleen. As shown in Table 88, expression was seen in the both the liver and spleen after intravenous and intramuscular administration and in the muscle around the intramuscular injection site.

TABLE 88

Luciferase Expression in Tissue

| | Expression (photon/second) |
|---|---|
| Luciferase LNP: IV Administration | |
| Liver | 7.984E+08 |
| Spleen | 3.951E+08 |
| Luciferase LNP: IM Administration | |
| Muscle around the injection site | 3.688E+07 |
| Liver | 1.507E+08 |
| Spleen | 1.096E+07 |

Example 62

Cytokine Study: PBMC

A. PBMC Isolation and Culture 50 mL of human blood from two donors was received from Research Blood Components (lots KP30928 and KP30931) in sodium heparin tubes. For each donor, the blood was pooled and diluted to 70 mL with DPBS (SAFC Bioscience 59331C, lot 071M8408) and split evenly between two 50 mL conical tubes. 10 mL of Ficoll Paque (GE Healthcare 17-5442-03, lot 10074400) was gently dispensed below the blood layer. The tubes were centrifuged at 2000 rpm for 30 minutes with low acceleration and braking. The tubes were removed and the buffy coat PBMC layers were gently transferred to a fresh 50 mL conical and washed with DPBS. The tubes were centrifuged at 1450 rpm for 10 minutes.

The supernatant was aspirated and the PBMC pellets were resuspended and washed in 50 mL of DPBS. The tubes were centrifuged at 1250 rpm for 10 minutes. This wash step was repeated, and the PBMC pellets were resuspended in 19 mL of Optimem I (Gibco 11058, lot 1072088) and counted. The cell suspensions were adjusted to a concentration of $3.0 \times 10^{\wedge}6$ cells/mL live cells.

These cells were then plated on five 96 well tissue culture treated round bottom plates (Costar 3799) per donor at 50 uL per well. Within 30 minutes, transfection mixtures were added to each well at a volume of 50 uL per well. After 4 hours post transfection, the media was supplemented with 10 uL of Fetal Bovine Serum (Gibco 10082, lot 1012368).

B. Transfection Preparation

Modified mRNA encoding human G-CSF (mRNA sequence shown in SEQ ID NO: 33897; polyA tail of approximately 160 nucleotides not shown in sequence; 5'cap, Cap1) (containing either (1) natural NTPs, (2) 100% substitution with 5-methyl cytidine and pseudouridine, or (3) 100% substitution with 5-methyl cytidine and N1-methyl pseudouridine; mRNA encoding luciferase (IVT cDNA sequence shown in SEQ ID NO: 33906; mRNA sequence shown in SEQ ID NO: 33907, polyA tail of approximately 160 nucleotides not shown in sequence, 5'cap, Cap1, fully modified with 5-methylcytosine at each cytosine and pseudouridine replacement at each uridine site) (containing either (1) natural NTPs or (2) 100% substitution with 5-methyl cytidine and pseudouridine) and TLR agonist R848 (Invivogen tlrl-r848) were diluted to 38.4 ng/uL in a final volume of 2500 uL Optimem I.

Separately, 110 uL of Lipofectamine 2000 (Invitrogen 11668-027, lot 1070962) was diluted with 6.76 mL Optimem I. In a 96 well plate nine aliquots of 135 uL of each mRNA, positive control (R-848) or negative control (Optimem I) was added to 135 uL of the diluted Lipofectamine 2000. The plate containing the material to be transfected was incubated for 20 minutes. The transfection mixtures were then transferred to each of the human PBMC plates at 50 uL per well. The plates were then incubated at 37° C. At 2, 4, 8, 20, and 44 hours each plate was removed from the incubator, and the supernatants were frozen.

After the last plate was removed, the supernatants were assayed using a human G-CSF ELISA kit (Invitrogen KHC2032) and human IFN-alpha ELISA kit (Thermo Scientific 41105-2). Each condition was done in duplicate.

C. Protein and Innate Immune Response Analysis

The ability of unmodified and modified mRNA to produce the encoded protein was assessed (G-CSF production) over time as was the ability of the mRNA to trigger innate immune recognition as measured by interferon-alpha production. Use of in vitro PBMC cultures is an accepted way to measure the immunostimulatory potential of oligonucleotides (Robbins et al., Oligonucleotides 2009 19:89-102).

Results were interpolated against the standard curve of each ELISA plate using a four parameter logistic curve fit. Shown in Tables 89 and 90 are the average from 3 separate PBMC donors of the G-CSF, interferon-alpha (IFN-alpha) and tumor necrosis factor alpha (TNF-alpha) production over time as measured by specific ELISA.

In the G-CSF ELISA, background signal from the Lipofectamine 2000 (LF2000) untreated condition was subtracted at each time point. The data demonstrated specific production of human G-CSF protein by human peripheral blood mononuclear is seen with G-CSF mRNA containing natural NTPs, 100% substitution with 5-methyl cytidine and pseudouridine, or 100% substitution with 5-methyl cytidine and N1-methyl pseudouridine. Production of G-CSF was significantly increased through the use of 5-methyl cytidine and N1-methyl pseudouridine modified mRNA relative to 5-methyl cytidine and pseudouridine modified mRNA.

With regards to innate immune recognition, while both modified mRNA chemistries largely prevented IFN-alpha and TNF-alpha production relative to positive controls (R848, p(I)p(C)), significant differences did exist between the chemistries. 5-methyl cytidine and pseudouridine modified mRNA resulted in low but detectable levels of IFN-alpha and TNF-alpha production, while 5-methyl cytidine and N1-methyl pseudouridine modified mRNA resulted in no detectable IFN-alpha and TNF-alpha production.

Consequently, it has been determined that, in addition to the need to review more than one cytokine marker of the activation of the innate immune response, it has surprisingly been found that combinations of modifications provide differing levels of cellular response (protein production and immune activation). The modification, N1-methyl pseudouridine, in this study has been shown to convey added protection over the standard combination of 5-methylcytidine/pseudouridine explored by others resulting in twice as much protein and almost 150 fold reduction in immune activation (TNF-alpha).

Given that PBMC contain a large array of innate immune RNA recognition sensors and are also capable of protein translation, it offers a useful system to test the interdependency of these two pathways. It is known that mRNA translation can be negatively affected by activation of such innate immune pathways (Kariko et al. Immunity (2005) 23:165-175; Warren et al. Cell Stem Cell (2010) 7:618-630; each of which is herein incorporated by reference in its entirety). Using PBMC as an in vitro assay system it is possible to establish a correlation between translation (in this case G-CSF protein production) and cytokine production (in this case exemplified by IFN-alpha and TNF-alpha protein production). Better protein production is correlated with lower induction of innate immune activation pathway, and new chemistries can be judged favorably based on this ratio (Table 91).

In this study, the PC Ratio for the two chemical modifications, pseudouridine and N1-methyl pseudouridine, both with 5-methy cytosine was 4742/141=34 as compared to 9944/1=9944 for the cytokine IFN-alpha. For the cytokine, TNF-alpha, the two chemistries had PC Ratios of 153 and 1243, respectively suggesting that for either cytokine, the N1-methylpseudouridine is the superior modification. In Tables 89 and 90, "NT" means not tested.

TABLE 89

G-CSF
G-CSF: 3 Donor Average (pg/ml)

| | |
|---|---|
| G-CSF 5-methylcytosine/pseudouridine | 4742 |
| G-CSF 5-methylcytosine/N1-methylpseudouridine | 9944 |
| Luciferase | 18 |
| LF2000 | 16 |

TABLE 90

IFN-alpha and TNF-alpha

| | IFN-alpha: 3 Donor Average (pg/ml) | TNF-alpha: 3 Donor Average (pg/ml) |
|---|---|---|
| G-CSF 5-methylcytosine/pseudouridine | 141 | 31 |
| G-CSF 5-methylcytosine/N1-methylpseudouridine | 1 | 8 |
| P(I)P(C) | 1104 | NT |
| R-848 | NT | 1477 |
| LF2000 | 17 | 25 |

TABLE 91

G-CSF to Cytokine Ratios

| | G-CSF/IFN-alpha (ratio) | | G-CSF/TNF-alpha (ratio) | |
|---|---|---|---|---|
| | 5-methylcytosine/pseudouridine | 5-methylcytosine/N1-methyl-pseudouridine | 5-methylcytosine/pseudouridine | 5-methylcytosine/N1-methyl-pseudouridine |
| PC Ratio | 34 | 9944 | 153 | 1243 |

Example 63

In Vitro PBMC Studies: Percent Modification 480 ng of G-CSF mRNA modified with 5-methylcytosine (5mC) and pseudouridine (pseudoU) or unmodified G-CSF mRNA was transfected with 0.4 uL of Lipofectamine 2000 into peripheral blood mononuclear cells (PBMC) from three normal blood donors (D1, D2, and D3). The G-CSF mRNA (mRNA sequence shown in SEQ ID NO: 33897; polyA tail of approximately 160 nucleotides not shown in sequence; 5'cap, Cap1) was completely modified with 5mC and pseudoU (100% modification), not modified with 5mC and pseudoU (0% modification) or was partially modified with 5mC and pseudoU so the mRNA would contain 75% modification, 50% modification or 25% modification. A control sample of Luciferase (mRNA sequence shown in SEQ ID NO: 33907; polyA tail of approximately 160 nucleotides not shown in sequence; 5'cap, Cap1; fully modified 5meC and pseudoU) was also analyzed for G-CSF expression. For TNF-alpha and IFN-alpha control samples of Lipofectamine2000, LPS, R-848, Luciferase (mRNA sequence shown in SEQ ID NO: 33907; polyA tail of approximately 160 nucleotides not shown in sequence; 5'cap, Cap1; fully modified 5mC and pseudo), and P(I)P(C) were also analyzed. The supernatant was harvested and run by ELISA 22 hours after transfection to determine the protein expression. The expression of G-CSF is shown in Table 94 and the expression of IFN-alpha and TNF-alpha is shown in Table 95. The expression of IFN-alpha and TNF-alpha may be a secondary effect from the transfection of the G-CSF mRNA. Tables 94 and 95 show that the amount of chemical modification of G-CSF, interferon alpha (IFN-alpha) and tumor necrosis factor-alpha (TNF-alpha) is titratable when the mRNA is not fully modified and the titratable trend is not the same for each target.

By using PBMC as an in vitro assay system it is possible to establish a correlation between translation (in this case G-CSF protein production) and cytokine production (in this case exemplified by IFN-alpha protein production). Better protein production is correlated with lower induction of innate immune activation pathway, and the percentage modification of a chemistry can be judged favorably based on this ratio (Table 96). As calculated from Tables 94 and 95 and shown in Table 96, full modification with 5-methylcytidine and pseudouridine shows a much better ratio of protein cytokine production than without any modification (natural G-CSF mRNA) (100-fold for IFN-alpha and 27-fold for TNF-alpha). Partial modification shows a linear relationship with increasingly less modification resulting in a lower protein cytokine ratio.

TABLE 94

G-CSF Expression

| | G-CSF Expression (pg/ml) | | |
|---|---|---|---|
| | D1 | D2 | D3 |
| 100% modification | 1968.9 | 2595.6 | 2835.7 |
| 75% modification | 566.7 | 631.4 | 659.5 |
| 50% modification | 188.9 | 187.2 | 191.9 |
| 25% modification | 139.3 | 126.9 | 102.0 |
| 0% modification | 194.8 | 182.0 | 183.3 |
| Luciferase | 90.2 | 0.0 | 22.1 |

TABLE 95

IFN-alpha and TNF-alpha Expression

| | IFN-alpha Expression (pg/ml) | | | TNF-alpha Expression (pg/ml) | | |
|---|---|---|---|---|---|---|
| | D1 | D2 | D3 | D1 | D2 | D3 |
| 100% modification | 336.5 | 78.0 | 46.4 | 115.0 | 15.0 | 11.1 |
| 75% modification | 339.6 | 107.6 | 160.9 | 107.4 | 21.7 | 11.8 |
| 50% modification | 478.9 | 261.1 | 389.7 | 49.6 | 24.1 | 10.4 |

TABLE 95-continued

IFN-alpha and TNF-alpha Expression

| | IFN-alpha Expression (pg/ml) | | | TNF-alpha Expression (pg/ml) | | |
|---|---|---|---|---|---|---|
| | D1 | D2 | D3 | D1 | D2 | D3 |
| 25% modification | 564.3 | 400.4 | 670.7 | 85.6 | 26.6 | 19.8 |
| 0% modification | 1421.6 | 810.5 | 1260.5 | 154.6 | 96.8 | 45.9 |
| LPS | 0.0 | 0.6 | 0.0 | 0.0 | 12.6 | 4.3 |
| R-848 | 0.5 | 3.0 | 14.1 | 655.2 | 989.9 | 420.4 |
| P(I)P(C) | 130.8 | 297.1 | 585.2 | 765.8 | 2362.7 | 1874.4 |
| Lipid only | 1952.2 | 866.6 | 855.8 | 248.5 | 82.0 | 60.7 |

TABLE 96

PC Ratio and Effect of Percentage of Modification

| % Modification | Average G-CSF (pg/ml) | Average IFN-a (pg/ml) | Average TNF-a (pg/ml) | G-CSF/IFN-alpha (PC ratio) | G-CSF/TNF-alpha (PC ratio) |
|---|---|---|---|---|---|
| 100 | 2466 | 153 | 47 | 16 | 52 |
| 75 | 619 | 202 | 47 | 3.1 | 13 |
| 50 | 189 | 376 | 28 | 0.5 | 6.8 |
| 25 | 122 | 545 | 44 | 0.2 | 2.8 |
| 0 | 186 | 1164 | 99 | 0.16 | 1.9 |

Example 64

Modified RNA Transfected in PBMC 500 ng of G-CSF mRNA modified with 5-methylcytosine (5mC) and pseudouridine (pseudoU) or unmodified G-CSF mRNA was transfected with 0.4 uL of Lipofectamine 2000 into peripheral blood mononuclear cells (PBMC) from three normal blood donors (D1, D2, and D3). The G-CSF mRNA (mRNA sequence shown in SEQ ID NO: 33897; polyA tail of approximately 160 nucleotides not shown in sequence; 5'cap, Cap1) was completely modified with 5mC and pseudoU (100% modification), not modified with 5mC and pseudoU (0% modification) or was partially modified with 5mC and pseudoU so the mRNA would contain 50% modification, 25% modification, 10% modification, %5 modification, 1% modification or 0.1% modification. A control sample of mCherry (mRNA sequence shown in SEQ ID NO: 33898; polyA tail of approximately 160 nucleotides not shown in sequence; 5'cap, Cap1; fully modified 5meC and pseudouridine), G-CSF fully modified with 5-methylcytosine and pseudouridine (Control G-CSF) and an untreated control was also analyzed for expression of G-CSF, tumor necrosis factor-alpha (TNF-alpha) and interferon-alpha (IFN-alpha). The supernatant was harvested 6 hours and 18 hours after transfection and run by ELISA to determine the protein expression. The expression of G-CSF, IFN-alpha, and TNF-alpha for Donor 1 is shown in Table 97, Donor 2 is shown in Table 98 and Donor 3 is shown in Table 99.

Full 100% modification with 5-methylcytidine and pseudouridine resulted in the most protein translation (G-CSF) and the least amount of cytokine produced across all three human PBMC donors. Decreasing amounts of modification results in more cytokine production (IFN-alpha and TNF-alpha), thus further highlighting the importance of fully modification to reduce cytokines and to improve protein translation (as evidenced here by G-CSF production).

TABLE 97

Donor 1

| | G-CSF (pg/mL) | | IFN-alpha (pg/mL) | | TNF-alpha (pg/mL) | |
|---|---|---|---|---|---|---|
| | 6 hours | 18 hours | 6 hours | 18 hours | 6 hours | 18 hours |
| 100% Mod | 1815 | 2224 | 1 | 13 | 0 | 0 |
| 75% Mod | 591 | 614 | 0 | 89 | 0 | 0 |
| 50% Mod | 172 | 147 | 0 | 193 | 0 | 0 |
| 25% Mod | 111 | 92 | 2 | 219 | 0 | 0 |
| 10% Mod | 138 | 138 | 7 | 536 | 18 | 0 |
| 1% Mod | 199 | 214 | 9 | 660 | 18 | 3 |
| 0.1% Mod | 222 | 208 | 10 | 597 | 0 | 6 |
| 0% Mod | 273 | 299 | 10 | 501 | 10 | 0 |
| Control G-CSF | 957 | 1274 | 3 | 123 | 18633 | 1620 |
| mCherry | 0 | 0 | 0 | 10 | 0 | 0 |
| Untreated | N/A | N/A | 0 | 0 | 1 | 1 |

TABLE 98

Donor 2

| | G-CSF (pg/mL) | | IFN-alpha (pg/mL) | | TNF-alpha (pg/mL) | |
|---|---|---|---|---|---|---|
| | 6 hours | 18 hours | 6 hours | 18 hours | 6 hours | 18 hours |
| 100% Mod | 2184 | 2432 | 0 | 7 | 0 | 11 |
| 75% Mod | 935 | 958 | 3 | 130 | 0 | 0 |
| 50% Mod | 192 | 253 | 2 | 625 | 7 | 23 |
| 25% Mod | 153 | 158 | 7 | 464 | 6 | 6 |
| 10% Mod | 203 | 223 | 25 | 700 | 22 | 39 |
| 1% Mod | 288 | 275 | 27 | 962 | 51 | 66 |
| 0.1% Mod | 318 | 288 | 33 | 635 | 28 | 5 |
| 0% Mod | 389 | 413 | 26 | 748 | 1 | 253 |
| Control G-CSF | 1461 | 1634 | 1 | 59 | 481 | 814 |
| mCherry | 0 | 7 | 0 | 1 | 0 | 0 |
| Untreated | N/A | N/A | 1 | 0 | 0 | 0 |

TABLE 99

Donor 3

| | G-CSF (pg/mL) | | IFN-alpha (pg/mL) | | TNF-alpha (pg/mL) | |
|---|---|---|---|---|---|---|
| | 6 hours | 18 hours | 6 hours | 18 hours | 6 hours | 18 hours |
| 100% Mod | 6086 | 7549 | 7 | 658 | 11 | 11 |
| 75% Mod | 2479 | 2378 | 23 | 752 | 4 | 35 |
| 50% Mod | 667 | 774 | 24 | 896 | 22 | 18 |
| 25% Mod | 480 | 541 | 57 | 1557 | 43 | 115 |
| 10% Mod | 838 | 956 | 159 | 2755 | 144 | 123 |
| 1% Mod | 1108 | 1197 | 235 | 3415 | 88 | 270 |
| 0.1% Mod | 1338 | 1177 | 191 | 2873 | 37 | 363 |
| 0% Mod | 1463 | 1666 | 215 | 3793 | 74 | 429 |
| Control G-CSF | 3272 | 3603 | 16 | 1557 | 731 | 9066 |
| mCherry | 0 | 0 | 2 | 645 | 0 | 0 |
| Untreated | N/A | N/A | 1 | 1 | 0 | 8 |

Example 65

Innate Immune Response Study in BJ Fibroblasts

A. Single Transfection

Human primary foreskin fibroblasts (BJ fibroblasts) were obtained from American Type Culture Collection (ATCC) (catalog #CRL-2522) and grown in Eagle's Minimum Essential Medium (ATCC, catalog #30-2003) supplemented with 10% fetal bovine serum at 37° C., under 5% $CO_2$. BJ fibroblasts were seeded on a 24-well plate at a density of 300,000 cells per well in 0.5 ml of culture medium. 250 ng of modified G-CSF mRNA (mRNA sequence shown in SEQ ID NO: 33897; polyA tail of approximately 140 nucleotides not shown in sequence; 5'cap, Cap1) fully modified with 5-methylcytosine and pseudouridine (Gen1) or fully modified with 5-methylcytosine and N1-methylpseudouridine (Gen2) having Cap0, Cap1 or no cap was transfected using Lipofectamine 2000 (Invitrogen, catalog #11668-019), following manufacturer's protocol. Control samples of poly I:C (PIC), Lipofectamine 2000 (Lipo), natural luciferase mRNA (mRNA sequence shown in SEQ ID NO: 33907; polyA tail of approximately 160 nucleotides not shown in sequence; 5'cap, Cap1) and natural G-CSF mRNA were also transfected. The cells were harvested after 18 hours, the total RNA was isolated and DNASE® treated using the RNeasy micro kit (catalog #74004) following the manufacturer's protocol. 100 ng of total RNA was used for cDNA synthesis using High Capacity cDNA Reverse Transcription kit (catalog #4368814) following the manufacturer's protocol. The cDNA was then analyzed for the expression of innate immune response genes by quantitative real time PCR using SybrGreen in a Biorad CFX 384 instrument following manufacturer's protocol. Table 100 shows the expression level of innate immune response transcripts relative to house-keeping gene HPRT (hypoxanthine phosphoribosytransferase) and is expressed as fold-induction relative to HPRT. In the table, the panel of standard metrics includes: RIG-I is retinoic acid inducible gene 1, IL6 is interleukin-6, OAS-1 is oligoadenylate synthetase 1, IFNb is interferon-beta, AIM2 is absent in melanoma-2, IFIT-1 is interferon-induced protein with tetratricopeptide repeats 1, PKR is protein kinase R, TNFa is tumor necrosis factor alpha and IFNa is interferon alpha.

TABLE 100

Innate Immune Response Transcript Levels

| Formulation | RIG-I | IL6 | OAS-1 | IFNb | AIM2 | IFIT-1 | PKR | TNFa | IFNa |
|---|---|---|---|---|---|---|---|---|---|
| Natural Luciferase | 71.5 | 20.6 | 20.778 | 11.404 | 0.251 | 151.218 | 16.001 | 0.526 | 0.067 |
| Natural G-CSF | 73.3 | 47.1 | 19.359 | 13.615 | 0.264 | 142.011 | 11.667 | 1.185 | 0.153 |
| PIC | 30.0 | 2.8 | 8.628 | 1.523 | 0.100 | 71.914 | 10.326 | 0.264 | 0.063 |
| G-CSF Gen1-UC | 0.81 | 0.22 | 0.080 | 0.009 | 0.008 | 2.220 | 1.592 | 0.090 | 0.027 |
| G-CSF Gen1-Cap0 | 0.54 | 0.26 | 0.042 | 0.005 | 0.008 | 1.314 | 1.568 | 0.088 | 0.038 |
| G-CSF Gen1-Cap1 | 0.58 | 0.30 | 0.035 | 0.007 | 0.006 | 1.510 | 1.371 | 0.090 | 0.040 |
| G-CSF Gen2-UC | 0.21 | 0.20 | 0.002 | 0.007 | 0.007 | 0.603 | 0.969 | 0.129 | 0.005 |
| G-CSF Gen2-Cap0 | 0.23 | 0.21 | 0.002 | 0.0014 | 0.007 | 0.648 | 1.547 | 0.121 | 0.035 |
| G-CSF Gen2-Cap1 | 0.27 | 0.26 | 0.011 | 0.004 | 0.005 | 0.678 | 1.557 | 0.099 | 0.037 |
| Lipo | 0.27 | 0.53 | 0.001 | 0 | 0.007 | 0.954 | 1.536 | 0.158 | 0.064 |

B. Repeat Transfection

Human primary foreskin fibroblasts (BJ fibroblasts) were obtained from American Type Culture Collection (ATCC) (catalog #CRL-2522) and grown in Eagle's Minimum Essential Medium (ATCC, catalog #30-2003) supplemented with 10% fetal bovine serum at 37° C., under 5% $CO_2$. BJ fibroblasts were seeded on a 24-well plate at a density of 300,000 cells per well in 0.5 ml of culture medium. 250 ng of modified G-CSF mRNA (mRNA sequence shown in SEQ ID NO: 33897; polyA tail of approximately 140 nucleotides not shown in sequence; 5'cap, Cap1) unmodified, fully modified with 5-methylcytosine and pseudouridine (Gen1) or fully modified with 5-methylcytosine and N1-methylpseudouridine (Gen2) was transfected daily for 5 days following manufacturer's protocol. Control samples of Lipofectamine 2000 (L2000) and mCherry mRNA (mRNA sequence shown in SEQ ID NO: 33898; polyA tail of approximately 160 nucleotides not shown in sequence; 5'cap, Cap1; fully modified with 5-methylcytidine and pseudouridine) were also transfected daily for 5 days. The results are shown in Table 101.

Unmodified mRNA showed a cytokine response in interferon-beta (IFN-beta) and interleukin-6 (IL-6) after one day. mRNA modified with at least pseudouridine showed a cytokine response after 2-3 days whereas mRNA modified with 5-methylcytosine and N1-methylpseudouridine showed a reduced response after 3-5 days.

TABLE 101

Cytokine Response

| Formulation | Transfection | IFN-beta (pg/ml) | IL-6 (pg/ml) |
|---|---|---|---|
| G-CSF unmodified | 6 hours | 0 | 3596 |
| | Day 1 | 1363 | 15207 |
| | Day 2 | 238 | 12415 |
| | Day 3 | 225 | 5017 |
| | Day 4 | 363 | 4267 |
| | Day 5 | 225 | 3094 |
| G-CSF Gen 1 | 6 hours | 0 | 3396 |
| | Day 1 | 38 | 3870 |
| | Day 2 | 1125 | 16341 |
| | Day 3 | 100 | 25983 |
| | Day 4 | 75 | 18922 |
| | Day 5 | 213 | 15928 |
| G-CSF Gen 2 | 6 hours | 0 | 3337 |
| | Day 1 | 0 | 3733 |
| | Day 2 | 150 | 974 |
| | Day 3 | 213 | 4972 |
| | Day 4 | 1400 | 4122 |
| | Day 5 | 350 | 2906 |
| mCherry | 6 hours | 0 | 3278 |
| | Day 1 | 238 | 3893 |
| | Day 2 | 113 | 1833 |

TABLE 101-continued

Cytokine Response

| Formulation | Transfection | IFN-beta (pg/ml) | IL-6 (pg/ml) |
|---|---|---|---|
| | Day 3 | 413 | 25539 |
| | Day 4 | 413 | 29233 |
| | Day 5 | 213 | 20178 |
| L2000 | 6 hours | 0 | 3270 |
| | Day 1 | 13 | 3933 |
| | Day 2 | 388 | 567 |
| | Day 3 | 338 | 1517 |
| | Day 4 | 475 | 1594 |
| | Day 5 | 263 | 1561 |

Example 66

In Vivo Detection of Innate Immune Response

In an effort to distinguish the importance of different chemical modification of mRNA on in vivo protein production and cytokine response in vivo, female BALB/C mice (n=5) are injected intramuscularly with G-CSF mRNA (G-CSF mRNA unmod) (mRNA sequence shown in SEQ ID NO: 33897; polyA tail of approximately 160 nucleotides not shown in sequence;) with a 5'cap of Cap1, G-CSF mRNA fully modified with 5-methylcytosine and pseudouridine (G-CSF mRNA 5mc/pU), G-CSF mRNA fully modified with 5-methylcytosine and N1-methylpseudouridine with (G-CSF mRNA 5mc/N1pU) or without a 5'cap (G-CSF mRNA 5mc/N1 pU no cap) or a control of either R848 or 5% sucrose as described in Table 102.

TABLE 102

Dosing Chart

| Formulation | Route | Dose (ug/mouse) | Dose (ul) |
|---|---|---|---|
| G-CSF mRNA unmod | I.M. | 200 | 50 |
| G-CSF mRNA 5mc/pU | I.M. | 200 | 50 |
| G-CSF mRNA 5mc/N1pU | I.M. | 200 | 50 |
| G-CSF mRNA 5mc/N1pU no cap | I.M. | 200 | 50 |
| R848 | I.M. | 75 | 50 |
| 5% sucrose | I.M. | — | 50 |
| Untreated | I.M. | — | — |

Blood is collected at 8 hours after dosing. Using ELISA the protein levels of G-CSF, TNF-alpha and IFN-alpha is determined by ELISA. 8 hours after dosing, muscle is collected from the injection site and quantitative real time polymerase chain reaction (QPCR) is used to determine the mRNA levels of RIG-I, PKR, AIM-2, IFIT-1, OAS-2, MDA-5, IFN-beta, TNF-alpha, IL-6, G-CSF, CD45 in the muscle.

Example 67

In Vivo Detection of Innate Immune Response Study

Female BALB/C mice (n=5) were injected intramuscularly with G-CSF mRNA (G-CSF mRNA unmod) (mRNA sequence shown in SEQ ID NO: 33897; polyA tail of approximately 160 nucleotides not shown in sequence;) with a 5'cap of Cap1, G-CSF mRNA fully modified with 5-methylcytosine and pseudouridine (G-CSF mRNA 5mc/pU), G-CSF mRNA fully modified with 5-methylcytosine and N1-methylpseudouridine with (G-CSF mRNA 5mc/N1pU) or without a 5'cap (G-CSF mRNA 5mc/N1 pU no cap) or a control of either R848 or 5% sucrose as described in Table 103. Blood is collected at 8 hours after dosing and using ELISA the protein levels of G-CSF and interferon-alpha (IFN-alpha) is determined by ELISA and are shown in Table 103.

As shown in Table 103, unmodified, 5mc/pU, and 5mc/N1pU modified G-CSF mRNA resulted in human G-CSF expression in mouse serum. The uncapped 5mC/N1pU modified G-CSF mRNA showed no human G-CSF expression in serum, highlighting the importance of having a 5'cap structure for protein translation.

As expected, no human G-CSF protein was expressed in the R848, 5% sucrose only, and untreated groups. Importantly, significant differences were seen in cytokine production as measured by mouse IFN-alpha in the serum. As expected, unmodified G-CSF mRNA demonstrated a robust cytokine response in vivo (greater than the R848 positive control). The 5mc/pU modified G-CSF mRNA did show a low but detectable cytokine response in vivo, while the 5mc/N1pU modified mRNA showed no detectable IFN-alpha in the serum (and same as vehicle or untreated animals).

Also, the response of 5mc/N1pU modified mRNA was the same regardless of whether it was capped or not. These in vivo results reinforce the conclusion that 1) that unmodified mRNA produce a robust innate immune response, 2) that this is reduced, but not abolished, through 100% incorporation of 5mc/pU modification, and 3) that incorporation of 5mc/N1pU modifications results in no detectable cytokine response.

Lastly, given that these injections are in 5% sucrose (which has no effect by itself), these result should accurately reflect the immunostimulatory potential of these modifications.

From the data it is evident that N1pU modified molecules produce more protein while concomitantly having little or no effect on IFN-alpha expression. It is also evident that capping is required for protein production for this chemical modification. The Protein Cytokine Ratio of 748 as compared to the PC Ratio for the unmodified mRNA (PC=9) means that this chemical modification is far superior as related to the effects or biological implications associated with IFN-alpha.

TABLE 103

Human G-CSF and Mouse IFN-alpha in serum

| Formulation | Route | Dose (ug/mouse) | Dose (ul) | G-CSF protein (pg/ml) | IFN-alpha expression (pg/ml) | PC Ratio |
|---|---|---|---|---|---|---|
| GCSF mRNA unmod | I.M. | 200 | 50 | 605.6 | 67.01 | 9 |
| GCSF mRNA 5mc/pU | I.M. | 200 | 50 | 356.5 | 8.87 | 40 |
| GCSF mRNA 5mc/N1pU | I.M. | 200 | 50 | 748.1 | 0 | 748 |
| GCSF mRNA 5mc/N1pU no cap | I.M. | 200 | 50 | 6.5 | 0 | 6.5 |
| R848 | I.M. | 75 | 50 | 3.4 | 40.97 | .08 |
| 5% sucrose | I.M. | — | 50 | 0 | 1.49 | 0 |
| Untreated | I.M. | — | — | 0 | 0 | 0 |

Example 68

In Vivo Delivery of Modified RNA

Protein production of modified mRNA was evaluated by delivering modified G-CSF mRNA or modified Factor IX mRNA to female Sprague Dawley rats (n=6). Rats were injected with 400 ug in 100 ul of G-CSF mRNA (mRNA sequence shown in SEQ ID NO: 33897; polyA tail of approximately 160 nucleotides not shown in sequence; 5'cap, Cap1) fully modified with 5-methylcytosine and pseudouridine (G-CSF Gen1), G-CSF mRNA fully modified with 5-methylcytosine and N1-methylpseudouridine (G-CSF Gen2) or Factor IX mRNA (mRNA sequence shown in SEQ ID NO: 33901; polyA tail of approximately 160 nucleotides not shown in sequence; 5'cap, Cap1) fully modified with 5-methylcytosine and pseudouridine (Factor IX Gen1) reconstituted from the lyophilized form in 5% sucrose. Blood was collected 8 hours after injection and the G-CSF protein level in serum was measured by ELISA. Table 104 shows the G-CSF protein levels in serum after 8 hours.

These results demonstrate that both G-CSF Gen 1 and G-CSF Gen 2 modified mRNA can produce human G-CSF protein in a rat following a single intramuscular injection, and that human G-CSF protein production is improved when using Gen 2 chemistry over Gen 1 chemistry.

TABLE 104

G-CSF Protein in Rat Serum (I.M. Injection Route)

| Formulation | G-CSF protein (pg/ml) |
|---|---|
| G-CSF Gen1 | 19.37 |
| G-CSF Gen2 | 64.72 |
| Factor IX Gen 1 | 2.25 |

Example 69

Chemical Modification: In Vitro Studies

A. In Vitro Screening in PBMC 500 ng of G-CSF (mRNA sequence shown in SEQ ID NO: 33897; polyA tail of approximately 160 nucleotides not shown in sequence; 5'cap, Cap1) mRNA fully modified with the chemical modification outlined Tables 105 and 106 was transfected with 0.4 uL Lipofectamine 2000 into peripheral blood mononuclear cells (PBMC) from three normal blood donors. Control samples of LPS, R848, P(I)P(C) and mCherry (mRNA sequence shown in SEQ ID NO: 33898; polyA tail of approximately 160 nucleotides not shown in sequence, 5'cap, Cap1; fully modified with 5-methylcytosine and pseudouridine) were also analyzed. The supernatant was harvested and stored frozen until analyzed by ELISA to determine the G-CSF protein expression, and the induction of the cytokines interferon-alpha (IFN-α) and tumor necrosis factor alpha (TNF-α). The protein expression of G-CSF is shown in Table 105, the expression of IFN-α and TNF-α is shown in Table 106.

The data in Table 105 demonstrates that many, but not all, chemical modifications can be used to productively produce human G-CSF in PBMC. Of note, 100% N1-methylpseudouridine substitution demonstrates the highest level of human G-CSF production (almost 10-fold higher than pseudouridine itself). When N1-methylpseudouridine is used in combination with 5-methylcytidine a high level of human G-CSF protein is also produced (this is also higher than when pseudouridine is used in combination with 5 methylcytidine).

Given the inverse relationship between protein production and cytokine production in PBMC, a similar trend is also seen in Table 106, where 100% substitution with N1-methylpseudouridine results no cytokine induction (similar to transfection only controls) and pseudouridine shows detectable cytokine induction which is above background.

Other modifications such as N6-methyladenosine and alpha-thiocytidine appear to increase cytokine stimulation.

TABLE 105

Chemical Modifications and G-CSF Protein Expression

| Chemical Modifications | G-CSF Protein Expression (pg/ml) | | |
|---|---|---|---|
| | Donor 1 | Donor 2 | Donor 3 |
| Pseudouridine | 2477 | 1,909 | 1,498 |
| 5-methyluridine | 318 | 359 | 345 |
| N1-methyl-pseudouridine | 21,495 | 16,550 | 12,441 |
| 2-thiouridine | 932 | 1,000 | 600 |
| 4-thiouridine | 5 | 391 | 218 |
| 5-methoxyuridine | 2,964 | 1,832 | 1,800 |
| 5-methylcytosine and pseudouridine ($1^{st}$ set) | 2,632 | 1,955 | 1,373 |
| 5-methylcytosine and N1-methyl-pseudouridine ($1^{st}$ set) | 10,232 | 7,245 | 6,214 |
| 2'Fluoroguanosine | 59 | 186 | 177 |
| 2'Fluorouridine | 118 | 209 | 191 |
| 5-methylcytosine and pseudouridine ($2^{nd}$ set) | 1,682 | 1,382 | 1,036 |
| 5-methylcytosine and N1-methyl-pseudouridine ($2^{nd}$ set) | 9,564 | 8,509 | 7,141 |
| 5-bromouridine | 314 | 482 | 291 |
| 5-(2-carbomethoxyvinyl)uridine | 77 | 286 | 177 |
| 5-[3(1-E-propenylamino)uridine | 541 | 491 | 550 |
| α-thiocytidine | 105 | 264 | 245 |
| 5-methylcytosine and pseudouridine ($3^{rd}$ set) | 1,595 | 1,432 | 955 |
| N1-methyladenosine | 182 | 177 | 191 |
| N6-methyladenosine | 100 | 168 | 200 |
| 5-methylcytidine | 291 | 277 | 359 |
| N4-acetylcytidine | 50 | 136 | 36 |
| 5-formylcytidine | 18 | 205 | 23 |
| 5-methylcytosine and pseudouridine ($4^{th}$ set) | 264 | 350 | 182 |
| 5-methylcytosine and N1-methyl-pseudouridine ($4^{th}$ set) | 9,505 | 6,927 | 5,405 |
| LPS | 1,209 | 786 | 636 |
| mCherry | 5 | 168 | 164 |
| R848 | 709 | 732 | 636 |
| P(I)P(C) | 5 | 186 | 182 |

TABLE 106

Chemical Modifications and Cytokine Expression

| Chemical Modifications | IFN-α Expression (pg/ml) | | | TNF-α Expression (pg/ml) | | |
|---|---|---|---|---|---|---|
| | Donor 1 | Donor 2 | Donor 3 | Donor 1 | Donor 2 | Donor 3 |
| Pseudouridine | 120 | 77 | 171 | 36 | 81 | 126 |
| 5-methyluridine | 245 | 135 | 334 | 94 | 100 | 157 |
| N1-methyl-pseudouridine | 26 | 75 | 138 | 101 | 106 | 134 |
| 2-thiouridine | 100 | 108 | 154 | 133 | 133 | 141 |
| 4-thiouridine | 463 | 258 | 659 | 169 | 126 | 254 |
| 5-methoxyuridine | 0 | 64 | 133 | 39 | 74 | 111 |
| 5-methylcytosine and pseudouridine ($1^{st}$ set) | 88 | 94 | 148 | 64 | 89 | 121 |

TABLE 106-continued

Chemical Modifications and Cytokine Expression

| Chemical Modifications | IFN-α Expression (pg/ml) | | | TNF-α Expression (pg/ml) | | |
|---|---|---|---|---|---|---|
| | Donor 1 | Donor 2 | Donor 3 | Donor 1 | Donor 2 | Donor 3 |
| 5-methylcytosine and N1-methyl-pseudouridine ($1^{st}$ set) | 0 | 60 | 136 | 54 | 79 | 126 |
| 2'Fluoroguanosine | 107 | 97 | 194 | 91 | 94 | 141 |
| 2'Fluorouridine | 158 | 103 | 178 | 164 | 121 | 156 |
| 5-methylcytosine and pseudouridine ($2^{nd}$ set) | 133 | 92 | 167 | 99 | 111 | 150 |
| 5-methylcytosine and N1-methyl-pseudouridine ($2^{nd}$ set) | 0 | 66 | 140 | 54 | 97 | 149 |
| 5-bromouridine | 95 | 86 | 181 | 87 | 106 | 157 |
| 5-(2-carbomethoxyvinyl)uridine | 0 | 61 | 130 | 40 | 81 | 116 |
| 5-[3(1-E-propenylamino)uridine | 0 | 58 | 132 | 71 | 90 | 119 |
| α-thiocytidine | 1,138 | 565 | 695 | 300 | 273 | 277 |
| 5-methylcytosine and pseudouridine ($3^{rd}$ set) | 88 | 75 | 150 | 84 | 89 | 130 |
| N1-methyladenosine | 322 | 255 | 377 | 256 | 157 | 294 |
| N6-methyladenosine | 1,935 | 1,065 | 1,492 | 1,080 | 630 | 857 |
| 5-methylcytidine | 643 | 359 | 529 | 176 | 136 | 193 |
| N4-acetylcytidine | 789 | 593 | 431 | 263 | 67 | 207 |
| 5-formylcytidine | 180 | 93 | 88 | 136 | 30 | 40 |
| 5-methylcytosine and pseudouridine ($4^{th}$ set) | 131 | 28 | 18 | 53 | 24 | 29 |
| 5-methylcytosine and N1-methyl-pseudouridine ($4^{th}$ set) | 0 | 0 | 0 | 36 | 14 | 13 |
| LPS | 0 | 67 | 146 | 7,004 | 3,974 | 4,020 |
| mCherry | 100 | 75 | 143 | 67 | 100 | 133 |
| R848 | 674 | 619 | 562 | 11,179 | 8,546 | 9,907 |
| P(I)P(C) | 470 | 117 | 362 | 249 | 177 | 197 |

B. In Vitro Screening in HeLa Cells

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37 oG in 5% $CO_2$ atmosphere overnight. Next day, 83 ng of Luciferase modified RNA (mRNA sequence shown in SEQ ID NO: 33907; polyA tail of approximately 160 nucleotides not shown in sequence; 5'cap, Cap1) with the chemical modification described in Table 107, were diluted in 10 ul final volume of OPTI-MEM (LifeTechnologies, Grand Island, N.Y.).

Lipofectamine 2000 (LifeTechnologies, Grand Island, N.Y.) was used as transfection reagent and 0.2 ul were diluted in 10 ul final volume of OPTI-MEM. After 5 minutes of incubation at room temperature, both solutions were combined and incubated an additional 15 minute at room temperature. Then the 20 ul combined solution was added to the 100 ul cell culture medium containing the HeLa cells and incubated at room temperature.

After 18 to 22 hours of incubation cells expressing luciferase were lysed with 100 ul of Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The lysate volumes were adjusted or diluted until no more than 2 mio relative light units (RLU) per well were detected for the strongest signal producing samples and the RLUs for each chemistry tested are shown in Table 107. The plate reader was a BioTek Synergy H1 (BioTek, Winooski, Vt.). The background signal of the plates without reagent was about 200 relative light units per well.

These results demonstrate that many, but not all, chemical modifications can be used to productively produce human G-CSF in HeLa cells. Of note, 100% N1-methyl-pseudouridine substitution demonstrates the highest level of human G-CSF production.

TABLE 107

Relative Light Units of Luciferase

| Chemical Modification | RLU |
|---|---|
| N6-methyladenosine (m6a) | 534 |
| 5-methylcytidine (m5c) | 138,428 |
| N4-acetylcytidine (ac4c) | 235,412 |
| 5-formylcytidine (f5c) | 436 |
| 5-methylcytosine/pseudouridine, test A1 | 48,659 |
| 5-methylcytosine/N1-methyl-pseudouridine, test A1 | 190,924 |
| Pseudouridine | 655,632 |

TABLE 107-continued

Relative Light Units of Luciferase

| Chemical Modification | RLU |
|---|---|
| 1-methylpseudouridine (m1u) | 1,517,998 |
| 2-thiouridine (s2u) | 3387 |
| 5-methoxyuridine (mo5u) | 253,719 |
| 5-methylcytosine/pseudouridine, test B1 | 317,744 |
| 5-methylcytosine/N1-methyl-pseudouridine, test B1 | 265,871 |
| 5-Bromo-uridine | 43,276 |
| 5 (2 carbovinyl) uridine | 531 |
| 5 (3-1E propenyl Amino) uridine | 446 |
| 5-methylcytosine/pseudouridine, test A2 | 295,824 |
| 5-methylcytosine/N1-methyl-pseudouridine, test A2 | 233,921 |
| 5-methyluridine | 50,932 |
| α-Thio-cytidine | 26,358 |
| 5-methylcytosine/pseudouridine, test B2 | 481,477 |
| 5-methylcytosine/N1-methyl-pseudouridine, test B2 | 271,989 |
| 5-methylcytosine/pseudouridine, test A3 | 438,831 |
| 5-methylcytosine/N1-methyl-pseudouridine, test A3 | 277,499 |
| Unmodified Luciferase | 234,802 |

C. In Vitro Screening in Rabbit Reticulocyte Lysates

Luciferase mRNA (mRNA sequence shown in SEQ ID NO: 33907; polyA tail of approximately 160 nucleotides not shown in sequence; 5'cap, Cap1) was modified with the chemical modification listed in Table 108 and were diluted in sterile nuclease-free water to a final amount of 250 ng in 10 ul. The diluted luciferase was added to 40 ul of freshly prepared Rabbit Reticulocyte Lysate and the in vitro translation reaction was done in a standard 1.5 mL polypropylene reaction tube (Thermo Fisher Scientific, Waltham, Mass.) at 30° C. in a dry heating block. The translation assay was done with the Rabbit Reticulocyte Lysate (nuclease-treated) kit (Promega, Madison, Wis.) according to the manufacturer's instructions. The reaction buffer was supplemented with a one-to-one blend of provided amino acid stock solutions devoid of either Leucine or Methionine resulting in a reaction mix containing sufficient amounts of both amino acids to allow effective in vitro translation.

After 60 minutes of incubation, the reaction was stopped by placing the reaction tubes on ice. Aliquots of the in vitro translation reaction containing luciferase modified RNA were transferred to white opaque polystyrene 96-well plates (Corning, Manassas, Va.) and combined with 100 ul complete luciferase assay solution (Promega, Madison, Wis.). The volumes of the in vitro translation reactions were adjusted or diluted until no more than 2 mio relative light units (RLUs) per well were detected for the strongest signal producing samples and the RLUs for each chemistry tested are shown in Table 108. The plate reader was a BioTek Synergy H1 (BioTek, Winooski, Vt.). The background signal of the plates without reagent was about 200 relative light units per well.

These cell-free translation results very nicely correlate with the protein production results in HeLa, with the same modifications generally working or not working in both systems. One notable exception is 5-formylcytidine modified luciferase mRNA which worked in the cell-free translation system, but not in the HeLa cell-based transfection system. A similar difference between the two assays was also seen with 5-formylcytidine modified G-CSF mRNA.

TABLE 108

Relative Light Units of Luciferase

| Chemical Modification | RLU |
|---|---|
| N6-methyladenosine (m6a) | 398 |
| 5-methylcytidine (m5c) | 152,989 |

TABLE 108-continued

Relative Light Units of Luciferase

| Chemical Modification | RLU |
|---|---|
| N4-acetylcytidine (ac4c) | 60,879 |
| 5-formylcytidine (f5c) | 55,208 |
| 5-methylcytosine/pseudouridine, test A1 | 349,398 |
| 5-methylcytosine/N1-methyl-pseudouridine, test A1 | 205,465 |
| Pseudouridine | 587,795 |
| 1-methylpseudouridine (m1u) | 589,758 |
| 2-thiouridine (s2u) | 708 |
| 5-methoxyuridine (mo5u) | 288,647 |
| 5-methylcytosine/pseudouridine, test B1 | 454,662 |
| 5-methylcytosine/N1-methyl-pseudouridine, test B1 | 223,732 |
| 5-Bromo-uridine | 221,879 |
| 5 (2 carbovinyl) uridine | 225 |
| 5 (3-1E propenyl Amino) uridine | 211 |
| 5-methylcytosine/pseudouridine, test A2 | 558,779 |
| 5-methylcytosine/N1-methyl-pseudouridine, test A2 | 333,082 |
| 5-methyluridine | 214,680 |
| α-Thio-cytidine | 123,878 |
| 5-methylcytosine/pseudouridine, test B2 | 487,805 |
| 5-methylcytosine/N1-methyl-pseudouridine, test B2 | 154,096 |
| 5-methylcytosine/pseudouridine, test A3 | 413,535 |
| 5-methylcytosine/N1-methyl-pseudouridine, test A3 | 292,954 |
| Unmodified Luciferase | 225,986 |

Example 70

Chemical Modification: In Vivo Studies

A. In Vivo Screening of G-CSF Modified mRNA

Balb-C mice (n=4) are intramuscularly injected in each leg with modified G-CSF mRNA (mRNA sequence shown in SEQ ID NO: 33897; polyA tail of approximately 160 nucleotides not shown in sequence; 5'cap, Cap1), fully modified with the chemical modifications outlined in Table 109, is formulated in 1×PBS. A control of luciferase modified mRNA (mRNA sequence shown in SEQ ID NO: 33907; polyA tail of approximately 160 nucleotides not shown in sequence; 5'cap, Cap1; fully modified with pseudouridine and 5-methylcytosine) and a control of PBS are also tested. After 8 hours serum is collected to determine G-CSF protein levels cytokine levels by ELISA.

TABLE 109

G-CSF

| mRNA | Chemical Modifications |
|---|---|
| G-CSF | Pseudouridine |
| G-CSF | 5-methyluridine |
| G-CSF | 2-thiouridine |
| G-CSF | 4-thiouridine |
| G-CSF | 5-methoxyuridine |
| G-CSF | 2'-fluorouridine |
| G-CSF | 5-bromouridine |
| G-CSF | 5-[3(1-E-propenylamino)uridine) |
| G-CSF | alpha-thio-cytidine |
| G-CSF | 5-methylcytidine |
| G-CSF | N4-acetylcytidine |
| G-CSF | Pseudouridine and 5-methylcytosine |
| G-CSF | N1-methyl-pseudouridine and 5-methylcytosine |
| Luciferase | Pseudouridine and 5-methylcytosine |
| PBS | None |

B. In Vivo Screening of Luciferase Modified mRNA

Balb-C mice (n=4) were subcutaneously injected with 200 ul containing 42 to 103 ug of modified luciferase mRNA (mRNA sequence shown in SEQ ID NO: 33907; polyA tail of approximately 160 nucleotides not shown in sequence; 5'cap, Cap1), fully modified with the chemical modifications outlined in Table 110, was formulated in 1×PBS. A control of PBS was also tested. The dosages of the modified luciferase mRNA is also outlined in Table 110. 8 hours after dosing the mice were imaged to determine luciferase expression. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse.

As demonstrated in Table 110, all luciferase mRNA modified chemistries demonstrated in vivo activity, with the exception of 2'-fluorouridine. In addition 1-methylpseudouridine modified mRNA demonstrated very high expression of luciferase (5-fold greater expression than pseudouridine containing mRNA).

TABLE 110

Luciferase Screening

| mRNA | Chemical Modifications | Dose (ug) of mRNA | Dose volume (ml) | Luciferase expression (photon/second) |
|---|---|---|---|---|
| Luciferase | 5-methylcytidine | 83 | 0.72 | 1.94E+07 |
| Luciferase | N4-acetylcytidine | 76 | 0.72 | 1.11E+07 |
| Luciferase | Pseudouridine | 95 | 1.20 | 1.36E+07 |
| Luciferase | 1-methylpseudo-uridine | 103 | 0.72 | 7.40E+07 |
| Luciferase | 5-methoxyuridine | 95 | 1.22 | 3.32E+07 |
| Luciferase | 5-methyluridine | 94 | 0.86 | 7.42E+06 |
| Luciferase | 5-bromouridine | 89 | 1.49 | 3.75E+07 |
| Luciferase | 2'-fluoroguanosine | 42 | 0.72 | 5.88E+05 |
| Luciferase | 2'-fluorocytidine | 47 | 0.72 | 4.21E+05 |
| Luciferase | 2'-flurorouridine | 59 | 0.72 | 3.47E+05 |
| PBS | None | — | 0.72 | 3.16E+05 |

Example 71

In Vivo Screening of Combination Luciferase Modified mRNA

Balb-C mice (n=4) were subcutaneously injected with 200 ul of 100 ug of modified luciferase mRNA (mRNA sequence shown in SEQ ID NO: 33907; polyA tail of approximately 160 nucleotides not shown in sequence; 5'cap, Cap1), fully modified with the chemical modifications outlined in Table 111, was formulated in 1×PBS. A control of PBS was also tested. 8 hours after dosing the mice were imaged to determine luciferase expression. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse.

As demonstrated in Table 111, all luciferase mRNA modified chemistries (in combination) demonstrated in vivo activity. In addition the presence of N1-methyl-pseudouridine in the modified mRNA (with N4-acetylcytidine or 5 methylcytidine) demonstrated higher expression than when the same combinations where tested using with pseudouridine. Taken together, these data demonstrate that N1-methyl-pseudouridine containing luciferase mRNA results in improved protein expression in vivo whether used alone (Table 110) or when used in combination with other modified nucleotides (Table 111).

TABLE 111

Luciferase Screening Combinations

| mRNA | Chemical Modifications | Luciferase expression (photon/second) |
|---|---|---|
| Luciferase | N4-acetylcytidine/pseudouridine | 4.18E+06 |
| Luciferase | N4-acetylcytidine/N1-methyl-pseudouridine | 2.88E+07 |
| Luciferase | 5-methylcytidine/5-methoxyuridine | 3.48E+07 |
| Luciferase | 5-methylcytidine/5-methyluridine | 1.44E+07 |
| Luciferase | 5-methylcytidine/where 50% of the uridine is replaced with 2-thiouridine | 2.39E+06 |
| Luciferase | 5-methylcytidine/pseudouridine | 2.36E+07 |
| Luciferase | 5-methylcytidine/N1-methyl-pseudouridine | 4.15E+07 |
| PBS | None | 3.59E+05 |

Example 72

Innate Immune Response in BJ Fibroblasts

Human primary foreskin fibroblasts (BJ fibroblasts) are obtained from American Type Culture Collection (ATCC) (catalog #CRL-2522) and grown in Eagle's Minimum Essential Medium (ATCC, cat#30-2003) supplemented with 10% fetal bovine serum at 37° C., under 5% $CO_2$. BJ fibroblasts are seeded on a 24-well plate at a density of 130,000 cells per well in 0.5 ml of culture medium. 250 ng of modified G-CSF mRNA (mRNA sequence shown in SEQ ID NO: 33897; polyA tail of approximately 160 nucleotides not shown in sequence; 5'cap, Cap1) fully modified with 5-methylcytosine and pseudouridine (Gen1) or fully modified with 5-methylcytosine and N1-methylpseudouridine (Gen2) is transfected using Lipofectamine 2000 (Invitrogen, cat#11668-019), following manufacturer's protocol. Control samples of Lipofectamine 2000 and unmodified G-CSF mRNA (natural G-CSF) are also transfected. The cells are transfected for five consecutive days. The transfection complexes are removed four hours after each round of transfection.

The culture supernatant is assayed for secreted G-CSF (R&D Systems, catalog #DCS50), tumor necrosis factor-alpha (TNF-alpha) and interferon alpha (IFN-alpha) by ELISA every day after transfection following manufacturer's protocols. The cells are analyzed for viability using CELL TITER GLO® (Promega, catalog #G7570) 6 hrs and 18 hrs after the first round of transfection and every alternate day following that. At the same time from the harvested cells, total RNA is isolated and treated with DNASE® using the RNAEASY micro kit (catalog #74004) following the manufacturer's protocol. 100 ng of total RNA is used for cDNA synthesis using the High Capacity cDNA Reverse Transcription kit (Applied Biosystems, cat #4368814) following the manufacturer's protocol. The cDNA is then analyzed for the expression of innate immune response genes by quantitative real time PCR using SybrGreen in a Biorad CFX 384 instrument following the manufacturer's protocol.

Example 73

In Vitro Transcription with Wild-Type T7 Polymerase

Luciferase mRNA (mRNA sequence shown in SEQ ID NO: 33907; polyA tail of approximately 160 nucleotides not shown in sequence; 5'cap, Cap1) and G-CSF mRNA (mRNA sequence shown in SEQ ID NO: 33897; polyA tail of approximately 160 nucleotides not shown in sequence; 5'cap, Cap1)

were fully modified with different chemistries and chemistry combinations listed in Tables 112-115 using wild-type T7 polymerase as previously described.

The yield of the translation reactions was determined by spectrophometric measurement (OD260) and the yield for Luciferase is shown in Table 112 and G-CSF is shown in Table 114.

The luciferase and G-CSF modified mRNA were also subjected to an enzymatic capping reaction and each modified mRNA capping reaction was evaluated for yield by spectrophometic measurement (OD260) and correct size assessed using bioanalyzer. The yield from the capping reaction for luciferase is shown in Table 113 and G-CSF is shown in Table 115.

TABLE 112

In vitro transcription chemistry for Luciferase

| Chemical Modification | Yield (mg) |
|---|---|
| N6-methyladenosine | 0.99 |
| 5-methylcytidine | 1.29 |
| N4-acetylcytidine | 1.0 |
| 5-formylcytidine | 0.55 |
| Pseudouridine | 2.0 |
| N1-methyl-pseudouridine | 1.43 |
| 2-thiouridine | 1.56 |
| 5-methoxyuridine | 2.35 |
| 5-methyluridine | 1.01 |
| α-Thio-cytidine | 0.83 |
| 5-Br-uridine (5Bru) | 1.96 |
| 5 (2 carbomethoxyvinyl) uridine | 0.89 |
| 5 (3-1E propenyl Amino) uridine | 2.01 |
| N4-acetylcytidine/pseudouridine | 1.34 |
| N4-acetylcytidine/N1-methyl-pseudouridine | 1.26 |
| 5-methylcytidine/5-methoxyuridine | 1.38 |
| 5-methylcytidine/5-bromouridine | 0.12 |
| 5-methylcytidine/5-methyluridine | 2.97 |
| 5-methylcytidine/half of the uridines are modified with 2-thiouridine | 1.59 |
| 5-methylcytidine/2-thiouridine | 0.90 |
| 5-methylcytidine/pseudouridine | 1.83 |
| 5-methylcytidine/N1-methyl-pseudouridine | 1.33 |

TABLE 113

| Chemical Modification | Yield (mg) |
|---|---|
| 5-methylcytidine | 1.02 |
| N4-acetylcytidine | 0.93 |
| 5-formylcytidine | 0.55 |
| Pseudouridine | 2.07 |
| N1-methyl-pseudouridine | 1.27 |
| 2-thiouridine | 1.44 |
| 5-methoxyuridine | 2 |
| 5-methyluridine | 0.8 |
| α-Thio-cytidine | 0.74 |
| 5-Br-uridine (5Bru) | 1.29 |
| 5 (2 carbomethoxyvinyl) uridine | 0.54 |
| 5 (3-1E propenyl Amino) uridine | 1.39 |
| N4-acetylcytidine/pseudouridine | 0.99 |
| N4-acetylcytidine/N1-methyl-pseudouridine | 1.08 |
| 5-methylcytidine/5-methoxyuridine | 1.13 |
| 5-methylcytidine/5-methyluridine | 1.08 |
| 5-methylcytidine/half of the uridines are modified with 2-thiouridine | 1.2 |
| 5-methylcytidine/2-thiouridine | 1.27 |
| 5-methylcytidine/pseudouridine | 1.19 |
| 5-methylcytidine/N1-methyl-pseudouridine | 1.04 |

TABLE 114

In vitro transcription chemistry and yield for G-CSF modified mRNA

| Chemical Modification | Yield (mg) |
|---|---|
| N6-methyladenosine | 1.57 |
| 5-methylcytidine | 2.05 |
| N4-acetylcytidine | 3.13 |
| 5-formylcytidine | 1.41 |
| Pseudouridine | 4.1 |
| N1-methyl-pseudouridine | 3.24 |
| 2-thiouridine | 3.46 |
| 5-methoxyuridine | 2.57 |
| 5-methyluridine | 4.27 |
| 4-thiouridine | 1.45 |
| 2'-F-uridine | 0.96 |
| α-Thio-cytidine | 2.29 |
| 2'-F-guanosine | 0.6 |
| N-1-methyladenosine | 0.63 |
| 5-Br-uridine (5Bru) | 1.08 |
| 5 (2 carbomethoxyvinyl) uridine | 1.8 |
| 5 (3-1E propenyl Amino) uridine | 2.09 |
| N4-acetylcytidine/pseudouridine | 1.72 |
| N4-acetylcytidine/N1-methyl-pseudouridine | 1.37 |
| 5-methylcytidine/5-methoxyuridine | 1.85 |
| 5-methylcytidine/5-methyluridine | 1.56 |
| 5-methylcytidine/half of the uridines are modified with 2-thiouridine | 1.84 |
| 5-methylcytidine/2-thiouridine | 2.53 |
| 5-methylcytidine/pseudouridine | 0.63 |
| N4-acetylcytidine/2-thiouridine | 1.3 |
| N4-acetylcytidine/5-bromouridine | 1.37 |
| 5-methylcytidine/N1-methyl-pseudouridine | 1.25 |
| N4-acetylcytidine/pseudouridine | 2.24 |

TABLE 115

Capping chemistry and yield for G-CSF modified mRNA

| Chemical Modification | Yield (mg) |
|---|---|
| N6-methyladenosine | 1.04 |
| 5-methylcytidine | 1.08 |
| N4-acetylcytidine | 2.73 |
| 5-formylcytidine | 0.95 |
| Pseudouridine | 3.88 |
| N1-methyl-pseudouridine | 2.58 |
| 2-thiouridine | 2.57 |
| 5-methoxyuridine | 2.05 |
| 5-methyluridine | 3.56 |
| 4-thiouridine | 0.91 |
| 2'-F-uridine | 0.54 |
| α-Thio-cytidine | 1.79 |
| 2'-F-guanosine | 0.14 |
| 5-Br-uridine (5Bru) | 0.79 |
| 5 (2 carbomethoxyvinyl) uridine | 1.28 |
| 5 (3-1E propenyl Amino) uridine | 1.78 |
| N4-acetylcytidine/pseudouridine | 0.29 |
| N4-acetylcytidine/N1-methyl-pseudouridine | 0.33 |
| 5-methylcytidine/5-methoxyuridine | 0.91 |
| 5-methylcytidine/5-methyluridine | 0.61 |
| 5-methylcytidine/half of the uridines are modified with 2-thiouridine | 1.24 |
| 5-methylcytidine/pseudouridine | 1.08 |
| N4-acetylcytidine/2-thiouridine | 1.34 |
| N4-acetylcytidine/5-bromouridine | 1.22 |
| 5-methylcytidine/N1-methyl-pseudouridine | 1.56 |

Example 74

In Vitro Transcription with Mutant T7 Polymerase

Luciferase mRNA (mRNA sequence shown in SEQ ID NO: 33907; polyA tail of approximately 160 nucleotides not shown in sequence; 5'cap, Cap1) and G-CSF mRNA (mRNA sequence shown in SEQ ID NO: 33897; polyA tail of approximately 160 nucleotides not shown in sequence; 5'cap, Cap1) were fully modified with different chemistries and chemistry combinations listed in Tables 116-119 using a mutant T7 polymerase (Durascribe® T7 Transcription kit (Cat. No. DS010925) (Epicentre®, Madison, Wis.).

The yield of the translation reactions was determined by spectrophometric measurement (OD260) and the yield for Luciferase is shown in Table 116 and G-CSF is shown in Table 118.

The luciferase and G-CSF modified mRNA were also subjected to an enzymatic capping reaction and each modified mRNA capping reaction was evaluated for yield by spectrophometic measurement (OD260) and correct size assessed using bioanalyzer. The yield from the capping reaction for luciferase is shown in Table 117 and G-CSF is shown in Table 119.

TABLE 116

In vitro transcription chemistry and yield for Luciferase modified mRNA

| Chemical Modification | Yield (ug) |
| --- | --- |
| 2'Fluorocytosine | 71.4 |
| 2'Fluorouridine | 57.5 |
| 5-methylcytosine/pseudouridine, test A | 26.4 |
| 5-methylcytosine/N1-methyl-pseudouridine, test A | 73.3 |
| N1-acetylcytidine/2-fluorouridine | 202.2 |
| 5-methylcytidine/2-fluorouridine | 131.9 |
| 2-fluorocytosine/pseudouridine | 119.3 |
| 2-fluorocytosine/N1-methyl-pseudouridine | 107.0 |
| 2-fluorocytosine/2-thiouridine | 34.7 |
| 2-fluorocytosine/5-bromouridine | 81.0 |
| 2-fluorocytosine/2-fluorouridine | 80.4 |
| 2-fluoroguanine/5-methylcytosine | 61.2 |
| 2-fluoroguanine/5-methylcytosine/pseudouridine | 65.0 |
| 2-fluoroguanine/5-methylcytidine/N1-methyl-pseudouridine | 41.2 |
| 2-fluoroguanine/pseudouridine | 79.1 |
| 2-fluoroguanine/N1-methyl-pseudouridine | 74.6 |
| 5-methylcytidine/pseudouridine, test B | 91.8 |
| 5-methylcytidine/N1-methyl-pseudouridine, test B | 72.4 |
| 2'fluoroadenosine | 190.98 |

TABLE 117

Capping chemistry and yield for Luciferase modified mRNA

| Chemical Modification | Yield (ug) |
| --- | --- |
| 2'Fluorocytosine | 19.2 |
| 2'Fluorouridine | 16.7 |
| 5-methylcytosine/pseudouridine, test A | 7.0 |
| 5-methylcytosine/N1-methyl-pseudouridine, test A | 21.5 |
| N1-acetylcytidine/2-fluorouridine | 47.5 |
| 5-methylcytidine/2-fluorouridine | 53.2 |
| 2-fluorocytosine/pseudouridine | 58.4 |
| 2-fluorocytosine/N1-methyl-pseudouridine | 26.2 |
| 2-fluorocytosine/2-thiouridine | 12.9 |
| 2-fluorocytosine/5-bromouridine | 26.5 |
| 2-fluorocytosine/2-fluorouridine | 35.7 |
| 2-fluoroguanine/5-methylcytosine | 24.7 |
| 2-fluoroguanine/5-methylcytosine/pseudouridine | 32.3 |
| 2-fluoroguanine/5-methylcytidine/N1-methyl-pseudouridine | 31.3 |
| 2-fluoroguanine/pseudouridine | 20.9 |
| 2-fluoroguanine/N1-methyl-pseudouridine | 29.8 |
| 5-methylcytidine/pseudouridine, test B | 58.2 |
| 5-methylcytidine/N1-methyl-pseudouridine, test B | 44.4 |

TABLE 118

In vitro transcription chemistry and yield for G-CSF modified mRNA

| Chemical Modification | Yield (ug) |
| --- | --- |
| 2'Fluorocytosine | 56.5 |
| 2'Fluorouridine | 79.4 |
| 5-methylcytosine/pseudouridine, test A | 21.2 |
| 5-methylcytosine/N1-methyl-pseudouridine, test A | 77.1 |
| N1-acetylcytidine/2-fluorouridine | 168.6 |
| 5-methylcytidine/2-fluorouridine | 134.7 |
| 2-fluorocytosine/pseudouridine | 97.8 |
| 2-fluorocytosine/N1-methyl-pseudouridine | 103.1 |
| 2-fluorocytosine/2-thiouridine | 58.8 |
| 2-fluorocytosine/5-bromouridine | 88.8 |
| 2-fluorocytosine/2-fluorouridine | 93.9 |
| 2-fluoroguanine/5-methylcytosine | 97.3 |
| 2-fluoroguanine/5-methylcytosine/pseudouridine | 96.0 |
| 2-fluoroguanine/5-methylcytidine/N1-methyl-pseudouridine | 82.0 |
| 2-fluoroguanine/pseudouridine | 68.0 |
| 2-fluoroguanine/N1-methyl-pseudouridine | 59.3 |
| 5-methylcytidine/pseudouridine, test B | 58.7 |
| 5-methylcytidine/N1-methyl-pseudouridine, test B | 78.0 |

TABLE 119

Capping chemistry and yield for G-CSF modified mRNA

| Chemical Modification | Yield (ug) |
| --- | --- |
| 2'Fluorocytosine | 16.9 |
| 2'Fluorouridine | 17.0 |
| 5-methylcytosine/pseudouridine, test A | 10.6 |
| 5-methylcytosine/N1-methyl-pseudouridine, test A | 22.7 |
| N1-acetylcytidine/2-fluorouridine | 19.9 |
| 5-methylcytidine/2-fluorouridine | 21.3 |
| 2-fluorocytosine/pseudouridine | 65.2 |
| 2-fluorocytosine/N1-methyl-pseudouridine | 58.9 |
| 2-fluorocytosine/2-thiouridine | 41.2 |
| 2-fluorocytosine/5-bromouridine | 35.8 |
| 2-fluorocytosine/2-fluorouridine | 36.7 |
| 2-fluoroguanine/5-methylcytosine | 36.6 |
| 2-fluoroguanine/5-methylcytosine/pseudouridine | 37.3 |
| 2-fluoroguanine/5-methylcytidine/N1-methyl-pseudouridine | 30.7 |
| 2-fluoroguanine/pseudouridine | 29.0 |
| 2-fluoroguanine/N1-methyl-pseudouridine | 22.7 |
| 5-methylcytidine/pseudouridine, test B | 60.4 |
| 5-methylcytidine/N1-methyl-pseudouridine, test B | 33.0 |

Example 75

2'O-methyl and 2'Fluoro Compounds

Luciferase mRNA (mRNA sequence shown in SEQ ID NO: 33907; polyA tail of approximately 160 nucleotides not shown in sequence; 5'cap, Cap1) were produced as fully modified versions with the chemistries in Table 120 and transcribed using mutant T7 polymerase (Durascribe® T7 Transcription kit (Cat. No. DS010925) (Epicentre®, Madison, Wis.). 2' fluoro-containing mRNA were made using Durascribe T7, however, 2'Omethyl-containing mRNA could not be transcribed using Durascribe T7.

Incorporation of 2'Omethyl modified mRNA might possibly be accomplished using other mutant T7 polymerases (Nat Biotechnol. (2004) 22:1155-1160; Nucleic Acids Res. (2002) 30:e138) or U.S. Pat. No. 7,309,570, the contents of each of which are incorporated herein by reference in their entirety. Alternatively, 2'OMe modifications could be introduced post-transcriptionally using enzymatic means.

Introduction of modifications on the 2' group of the sugar has many potential advantages. 2'OMe substitutions, like 2' fluoro substitutions are known to protect against nucleases and also have been shown to abolish innate immune recognition when incorporated into other nucleic acids such as siRNA and anti-sense (incorporated in its entirety, Crooke, ed. Antisense Drug Technology, 2$^{nd}$ edition; Boca Raton: CRC press).

The 2'Fluoro-modified mRNA were then transfected into HeLa cells to assess protein production in a cell context and the same mRNA were also assessed in a cell-free rabbit reticulocyte system. A control of unmodified luciferase (natural luciferase) was used for both transcription experiments, a control of untreated and mock transfected (Lipofectamine 2000 alone) were also analyzed for the HeLa transfection and a control of no RNA was analyzed for the rabbit reticulysates.

For the HeLa transfection experiments, the day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37oG in 5% $CO_2$ atmosphere overnight. Next day, 83 ng of the 2' fluoro-containing luciferase modified RNA (mRNA sequence shown in SEQ ID NO: 33907; polyA tail of approximately 160 nucleotides not shown in sequence; 5'cap, Cap1) with the chemical modification described in Table 120, were diluted in 10 ul final volume of OPTI-MEM (LifeTechnologies, Grand Island, N.Y.). Lipofectamine 2000 (LifeTechnologies, Grand Island, N.Y.) was used as transfection reagent and 0.2 ul were diluted in 10 ul final volume of OPTI-MEM. After 5 minutes of incubation at room temperature, both solutions were combined and incubated an additional 15 minute at room temperature. Then the 20 ul combined solution was added to the 100 ul cell culture medium containing the HeLa cells and incubated at room temperature. After 18 to 22 hours of incubation cells expressing luciferase were lysed with 100 ul of Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The lysate volumes were adjusted or diluted until no more than 2 mio relative light units (RLU) per well were detected for the strongest signal producing samples and the RLUs for each chemistry tested are shown in Table 120. The plate reader was a BioTek Synergy H1 (BioTek, Winooski, Vt.). The background signal of the plates without reagent was about 200 relative light units per well.

For the rabbit reticulocyte lysate assay, 2'-fluoro-containing luciferase mRNA were diluted in sterile nuclease-free water to a final amount of 250 ng in 10 ul and added to 40 ul of freshly prepared Rabbit Reticulocyte Lysate and the in vitro translation reaction was done in a standard 1.5 mL polypropylene reaction tube (Thermo Fisher Scientific, Waltham, Mass.) at 30° C. in a dry heating block. The translation assay was done with the Rabbit Reticulocyte Lysate (nuclease-treated) kit (Promega, Madison, Wis.) according to the manufacturer's instructions. The reaction buffer was supplemented with a one-to-one blend of provided amino acid stock solutions devoid of either Leucine or Methionine resulting in a reaction mix containing sufficient amounts of both amino acids to allow effective in vitro translation. After 60 minutes of incubation, the reaction was stopped by placing the reaction tubes on ice.

Aliquots of the in vitro translation reaction containing luciferase modified RNA were transferred to white opaque polystyrene 96-well plates (Corning, Manassas, Va.) and combined with 100 ul complete luciferase assay solution (Promega, Madison, Wis.). The volumes of the in vitro translation reactions were adjusted or diluted until no more than 2 mio relative light units (RLUs) per well were detected for the strongest signal producing samples and the RLUs for each chemistry tested are shown in Table 121. The plate reader was a BioTek Synergy H1 (BioTek, Winooski, Vt.). The background signal of the plates without reagent was about 160 relative light units per well.

As can be seen in Table 120 and 121, multiple 2'Fluoro-containing compounds are active in vitro and produce luciferase protein.

TABLE 120

| HeLa Cells | | | | |
|---|---|---|---|---|
| Chemical Modification | Concentration (ug/ml) | Volume (ul) | Yield (ug) | RLU |
| 2'Fluoroadenosine | 381.96 | 500 | 190.98 | 388.5 |
| 2'Fluorocytosine | 654.56 | 500 | 327.28 | 2420 |
| 2'Fluoroguanine | 541,795 | 500 | 270.90 | 11,705.5 |
| 2'Flurorouridine | 944.005 | 500 | 472.00 | 6767.5 |
| Natural luciferase | N/A | N/A | N/A | 133,853.5 |
| Mock | N/A | N/A | N/A | 340 |
| Untreated | N/A | N/A | N/A | 238 |

TABLE 121

| Rabbit Reticulysates | |
|---|---|
| Chemical Modification | RLU |
| 2'Fluoroadenosine | 162 |
| 2'Fluorocytosine | 208 |
| 2'Fluoroguanine | 371,509 |
| 2'Flurorouridine | 258 |
| Natural luciferase | 2,159,968 |
| No RNA | 156 |

Example 76

Luciferase in HeLa Cells Using a Combination of Modifications

To evaluate using of 2' fluoro-modified mRNA in combination with other modification a series of mRNA were transcribed using either wild-type T7 polymerase (non-fluoro-containing compounds) or using mutant T7 polymerases (fluyoro-containing compounds) as described in Example 75. All modified mRNA were tested by in vitro transfection in HeLa cells.

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37oG in 5% $CO_2$ atmosphere overnight. Next day, 83 ng of Luciferase modified RNA (mRNA sequence shown in SEQ ID NO: 33907; polyA tail of approximately 160 nucleotides not shown in sequence; 5'cap, Cap1) with the chemical modification described in Table 122, were diluted in 10 ul final volume of OPTI-MEM (LifeTechnologies, Grand Island, N.Y.).

Lipofectamine 2000 (LifeTechnologies, Grand Island, N.Y.) was used as transfection reagent and 0.2 ul were diluted in 10 ul final volume of OPTI-MEM. After 5 minutes of incubation at room temperature, both solutions were combined and incubated an additional 15 minute at room temperature. Then the 20 ul combined solution was added to the 100 ul cell culture medium containing the HeLa cells and incubated at room temperature.

After 18 to 22 hours of incubation cells expressing luciferase were lysed with 100 ul of Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The lysate volumes were adjusted or diluted until no more than 2 mio relative light units (RLU) per well were detected for the strongest signal producing samples and the RLUs for each chemistry tested are shown in Table 122. The plate reader was a BioTek Synergy H1 (BioTek, Winooski, Vt.). The background signal of the plates without reagent was about 200 relative light units per well.

As evidenced in Table 122, most combinations of modifications resulted in mRNA which produced functional luciferase protein, including all the non-fluoro containing compounds and many of the combinations containing 2' fluoro modifications.

TABLE 122

Luciferase

| Chemical Modification | RLU |
|---|---|
| N4-acetylcytidine/pseudouridine | 113,796 |
| N4-acetylcytidine/N1-methyl-pseudouridine | 316,326 |
| 5-methylcytidine/5-methoxyuridine | 24,948 |
| 5-methylcytidine/5-methyluridine | 43,675 |
| 5-methylcytidine/half of the uridines modified with 50% 2-thiouridine | 41,601 |
| 5-methylcytidine/2-thiouridine | 1,102 |
| 5-methylcytidine/pseudouridine | 51,035 |
| 5-methylcytidine/N1-methyl-pseudouridine | 152,151 |
| N4-acetylcytidine/2'Fluorouridine triphosphate | 288 |
| 5-methylcytidine/2'Fluorouridine triphosphate | 269 |
| 2'Fluorocytosine triphosphate/pseudouridine | 260 |
| 2'Fluorocytosine triphosphate/N1-methyl-pseudouridine | 412 |
| 2'Fluorocytosine triphosphate/2-thiouridine | 427 |
| 2'Fluorocytosine triphosphate/5-bromouridine | 253 |
| 2'Fluorocytosine triphosphate/2'Fluorouridine triphosphate | 184 |
| 2'Fluoroguanine triphosphate/5-methylcytidine | 321 |
| 2'Fluoroguanine triphosphate/5-methylcytidine/Pseudouridine | 207 |
| 2'Fluoroguanine triphosphate/5-methylcytidine/N1-methyl-psuedouridine | 235 |
| 2'Fluoroguanine/pseudouridine | 218 |
| 2'Fluoroguanine/N1-methyl-psuedouridine | 247 |
| 5-methylcytidine/pseudouridine, test A | 13,833 |
| 5-methylcytidine/N1-methyl-pseudouridine, test A | 598 |
| 2'Fluorocytosine triphosphate | 201 |
| 2'Fluorouridine triphosphate | 305 |
| 5-methylcytidine/pseudouridine, test B | 115,401 |
| 5-methylcytidine/N1-methyl-pseudouridine, test B | 21,034 |
| Natural luciferase | 30,801 |
| Untreated | 344 |
| Mock | 262 |

Example 77

G-CSF In Vitro Transcription

To assess the activity of all our different chemical modifications in the context of a second open reading frame, we replicated experiments previously conducted using luciferase mRNA, with human G-CSF mRNA. G-CSF mRNA (mRNA sequence shown in SEQ ID NO: 33897; polyA tail of approximately 160 nucleotides not shown in sequence; 5'cap, Cap1) were fully modified with the chemistries in Tables 124 and 125 using wild-type T7 polymerase (for all non-fluoro-containing compounds) or mutant T7 polymerase (for all fluoro-containing compounds). The mutant T7 polymerase was obtained commercially (Durascribe® T7 Transcription kit (Cat. No. DS010925) (Epicentre®, Madison, Wis.).

The modified RNA in Tables 124 and 125 were transfected in vitro in HeLa cells or added to rabbit reticulysates (250 ng of modified mRNA) as indicated. A control of untreated, mock transfected (transfection reagent alone), G-CSF fully modified with 5-methylcytosine and N1-methyl-pseudouridine or luciferase control (mRNA sequence shown in SEQ ID NO: 33907; polyA tail of approximately 160 nucleotides not shown in sequence; 5'cap, Cap1) fully modified with 5-methylcytosine and N1-methylpseudouridine were also analyzed. The expression of G-CSF protein was determined by ELISA and the values are shown in Tables 124 and 125. In Table 124, "NT" means not tested.

As shown in Table 124, many, but not all, chemical modifications resulted in human G-CSF protein production. These results from cell-based and cell-free translation systems correlate very nicely with the same modifications generally working or not working in both systems. One notable exception is 5-formylcytidine modified G-CSF mRNA which worked in the cell-free translation system, but not in the HeLa cell-based transfection system. A similar difference between the two assays was also seen with 5-formylcytidine modified luciferase mRNA.

As demonstrated in Table 125, many, but not all, G-CSF mRNA modified chemistries (when used in combination) demonstrated in vivo activity. In addition the presence of N1-methyl-pseudouridine in the modified mRNA (with N4-acetylcytidine or 5 methylcytidine) demonstrated higher expression than when the same combinations where tested using with pseudouridine. Taken together, these data demonstrate that N1-methyl-pseudouridine containing G-CSF mRNA results in improved protein expression in vitro.

TABLE 124

G-CSF Expression

| Chemical Modification | G-CSF protein (pg/ml) HeLa cells | G-CSF protein (pg/ml) Rabbit reticulysates cells |
|---|---|---|
| Pseudouridine | 1,150,909 | 147,875 |
| 5-methyluridine | 347,045 | 147,250 |
| 2-thiouridine | 417,273 | 18,375 |
| N1-methylpseudouridine | NT | 230,000 |
| 4-thiouridine | 107,273 | 52,375 |
| 5-methoxyuridine | 1,715,909 | 201,750 |
| 5-methylcytosine/pseudouridine, Test A | 609,545 | 119,750 |
| 5-methylcytosine/N1-methyl-pseudouridine, Test A | 1,534,318 | 110,500 |
| 2'-Fluoro-guanosine | 11,818 | 0 |
| 2'-Fluoro-uridine | 60,455 | 0 |
| 5-methylcytosine/pseudouridine, Test B | 358,182 | 57,875 |
| 5-methylcytosine/N1-methyl-pseudouridine, Test B | 1,568,636 | 76,750 |
| 5-Bromo-uridine | 186,591 | 72,000 |
| 5-(2carbomethoxyvinyl) uridine | 1,364 | 0 |
| 5-[3(1-E-propenylamino) uridine | 27,955 | 32,625 |
| α-thio-cytidine | 120,455 | 42,625 |
| 5-methylcytosine/pseudouridine, Test C | 882,500 | 49,250 |
| N1-methyl-adenosine | 4,773 | 0 |
| N6-methyl-adenosine | 1,591 | 0 |
| 5-methyl-cytidine | 646,591 | 79,375 |
| N4-acetylcytidine | 39,545 | 8,000 |
| 5-formyl-cytidine | 0 | 24,000 |

TABLE 124-continued

G-CSF Expression

| Chemical Modification | G-CSF protein (pg/ml) HeLa cells | G-CSF protein (pg/ml) Rabbit reticulysates cells |
|---|---|---|
| 5-methylcytosine/pseudouridine, Test D | 87,045 | 47,750 |
| 5-methylcytosine/N1-methyl-pseudouridine, Test D | 1,168,864 | 97,125 |
| Mock | 909 | 682 |
| Untreated | 0 | 0 |
| 5-methylcytosine/N1-methyl-pseudouridine, Control | 1,106,591 | NT |
| Luciferase control | NT | 0 |

TABLE 125

Combination Chemistries in HeLa cells

| Chemical Modification | G-CSF protein (pg/ml) HeLa cells |
|---|---|
| N4-acetylcytidine/pseudouridine | 537,273 |
| N4-acetylcytidine/N1-methyl-pseudouridine | 1,091,818 |
| 5-methylcytidine/5-methoxyuridine | 516,136 |
| 5-methylcytidine/5-bromouridine | 48,864 |
| 5-methylcytidine/5-methyluridine | 207,500 |
| 5-methylcytidine/2-thiouridine | 33,409 |
| N4-acetylcytidine/5-bromouridine | 211,591 |
| N4-acetylcytidine/2-thiouridine | 46,136 |
| 5-methylcytosine/pseudouridine | 301,364 |
| 5-methylcytosine/N1-methyl-pseudouridine | 1,017,727 |
| N4-acetylcytidine/2'Fluorouridine triphosphate | 62,273 |
| 5-methylcytidine/2'Fluorouridine triphosphate | 49,318 |
| 2'Fluorocytosine triphosphate/pseudouridine | 7,955 |
| 2'Fluorocytosine triphosphate/N1-methyl-pseudouridine | 1,364 |
| 2'Fluorocytosine triphosphate/2-thiouridine | 0 |
| 2'Fluorocytosine triphosphate/5-bromouridine | 1,818 |
| 2'Fluorocytosine triphosphate/2'Fluorouridine triphosphate | 909 |
| 2'Fluoroguanine triphosphate/5-methylcytidine | 0 |
| 2'Fluoroguanine triphosphate/5-methylcytidine/pseudouridine | 0 |
| 2'Fluoroguanine triphosphate/5-methylcytidine/N1-methyl-pseudouridine | 1,818 |
| 2'Fluoroguanine triphosphate/pseudouridine | 1,136 |
| 2'Fluoroguanine triphosphate/2'Fluorocytosine triphosphate/N1-methyl-pseudouridine | 0 |
| 5-methylcytidine/pseudouridine | 617,727 |
| 5-methylcytidine/N1-methyl-pseudouridine | 747,045 |
| 5-methylcytidine/pseudouridine | 475,455 |
| 5-methylcytidine/N1-methyl-pseudouridine | 689,091 |
| 5-methylcytosine/N1-methyl-pseudouridine, Control 1 | 848,409 |
| 5-methylcytosine/N1-methyl-pseudouridine, Control 2 | 581,818 |
| Mock | 682 |
| Untreated | 0 |
| Luciferase 2'Fluorocytosine triphosphate | 0 |
| Luciferase 2'Fluorouridine triphosphate | 0 |

Example 78

Screening of Chemistries

The tables listed in below (Tables 126-128) summarize much of the in vitro and in vitro screening data with the different compounds presented in the previous examples. A good correlation exists between cell-based and cell-free translation assays. The same chemistry substitutions generally show good concordance whether tested in the context of luciferase or G-CSF mRNA. Lastly, N1-methyl-pseudouridine containing mRNA show a very high level of protein expression with little to no detectable cytokine stimulation in vitro and in vivo, and is superior to mRNA containing pseudouridine both in vitro and in vivo.

Luciferase mRNA (mRNA sequence shown in SEQ ID NO: 33907; polyA tail of approximately 160 nucleotides not shown in sequence; 5'cap, Cap1) and G-CSF mRNA (mRNA sequence shown in SEQ ID NO: 33897; polyA tail of approximately 160 nucleotides not shown in sequence; 5'cap, Cap1) were modified with naturally and non-naturally occurring chemistries described in Tables 126 and 127 or combination chemistries described in Table 128 and tested using methods described herein.

In Tables 126 and 127, "*" refers to in vitro transcription reaction using a mutant T7 polymerase (Durascribe® T7 Transcription kit (Cat. No. DS010925) (Epicentre®, Madison, Wis.); "" refers to the second result in vitro transcription reaction using a mutant T7 polymerase (Durascribe® T7 Transcription kit (Cat. No. DS010925) (Epicentre®, Madison, Wis.); "*" refers to production seen in cell free translations (rabbit reticulocyte lysates); the protein production of HeLa is judged by "+," "+/−" and "−"; when referring to G-CSF PBMC "++++" means greater than 6,000 pg/ml G-CSF, "+++" means greater than 3,000 pg/ml G-CSF, "++" means greater than 1,500 pg/ml G-CSF, "+" means greater than 300 pg/ml G-CSF, "+/−" means 150-300 pg/ml G-CSF and the background was about 110 pg/ml; when referring to cytokine PBMC "++++" means greater than 1,000 pg/ml interferon-alpha (IFN-alpha), "+++" means greater than 600 pg/ml IFN-alpha, "++" means greater than 300 pg/ml IFN-alpha, "+" means greater than 100 pg/ml IFN-alpha, "−" means less than 100 pg/ml and the background was about 70 pg/ml; and "NT" means not tested. In Table 1277, the protein production was evaluated using a mutant T7 polymerase (Durascribe® T7 Transcription kit (Cat. No. DS010925) (Epicentre®, Madison, Wis.).

TABLE 126

Naturally Occurring

| Common Name (symbol) | IVT (Luc) | IVT (G-CSF) | Protein (Luc; HeLa) | Protein (G-CSF; HeLa) | Protein (G-CSF; PBMC) | Cytokines (G-CSF; PBMC) | In Vivo Protein (Luc) | In Vivo Protein (G-CSF) |
|---|---|---|---|---|---|---|---|---|
| 1-methyladenosine ($m^1A$) | Fail | Pass | NT | − | +/− | ++ | NT | NT |
| $N^6$-methyladenosine ($m^6A$) | Pass | Pass | − | − | +/− | ++++ | NT | NT |

TABLE 126-continued

Naturally Occurring

| Common Name (symbol) | IVT (Luc) | IVT (G-CSF) | Protein (Luc; HeLa) | Protein (G-CSF; HeLa) | Protein (G-CSF; PBMC) | Cytokines (G-CSF; PBMC) | In Vivo Protein (Luc) | In Vivo Protein (G-CSF) |
|---|---|---|---|---|---|---|---|---|
| 2'-O-methyladenosine (Am) | Fail* | Not Done | NT | NT | NT | NT | NT | NT |
| 5-methylcytidine ($m^5C$) | Pass | Pass | + | + | + | ++ | + | NT |
| 2'-O-methylcytidine (Cm) | Fail* | Not Done | NT | NT | NT | NT | NT | NT |
| 2-thiocytidine ($s^2C$) | Fail | Fail | NT | NT | NT | NT | NT | NT |
| $N^4$-acetylcytidine ($ac^4C$) | Pass | Pass | + | + | +/− | +++ | + | NT |
| 5-formylcytidine ($f^5C$) | Pass | Pass | −*** | −*** | − | + | NT | NT |
| 2'-O-methylguanosine (Gm) | Fail* | Not Done | NT | NT | NT | NT | NT | NT |
| inosine (I) | Fail | Fail | NT | NT | NT | NT | NT | NT |
| pseudouridine (Y) | Pass | Pass | + | + | ++ | + | + | NT |
| 5-methyluridine ($m^5U$) | Pass | Pass | + | + | +/− | + | NT | NT |
| 2'-O-methyluridine (Um) | Fail* | Not Done | NT | NT | NT | NT | NT | NT |
| 1-methylpseudouridine ($m^1Y$) | Pass | Pass | + | Not Done | ++++ | − | + | NT |
| 2-thiouridine ($s^2U$) | Pass | Pass | − | + | + | + | NT | NT |
| 4-thiouridine ($s^4U$) | Fail | Pass | | + | +/− | ++ | NT | NT |
| 5-methoxyuridine ($mo^5U$) | Pass | Pass | + | + | ++ | − | + | NT |
| 3-methyluridine ($m^3U$) | Fail | Fail | NT | NT | NT | NT | NT | NT |

TABLE 127

Non-Naturally Occurring

| Common Name | IVT (Luc) | IVT (G-CSF) | Protein (Luc; HeLa) | Protein (G-CSF; HeLa) | Protein (G-CSF; PBMC) | Cytokines (G-CSF; PBMC) | In Vivo Protein (Luc) | In Vivo Protein (G-CSF) |
|---|---|---|---|---|---|---|---|---|
| 2'-F-ara-guanosine | Fail | Fail | NT | NT | NT | NT | NT | NT |
| 2'-F-ara-adenosine | Fail | Fail | NT | NT | NT | NT | NT | NT |
| 2'-F-ara-cytidine | Fail | Fail | NT | NT | NT | NT | NT | NT |
| 2'-F-ara-uridine | Fail | Fail | NT | NT | NT | NT | NT | NT |
| 2'-F-guanosine | Fail/Pass** | Pass/Fail** | +** | +/− | − | + | + | NT |
| 2'-F-adenosine | Fail/Pass** | Fail/Fail** | −** | NT | NT | NT | NT | NT |
| 2'-F-cytidine | Fail/Pass** | Fail/Pass** | +** | NT | NT | NT | + | NT |
| 2'-F-uridine | Fail/Pass** | Pass/Pass** | +** | + | +/− | + | − | NT |
| 2'-OH-ara-guanosine | Fail | Fail | NT | NT | NT | NT | NT | NT |
| 2'-OH-ara-adenosine | Not Done | Not Done | NT | NT | NT | NT | NT | NT |
| 2'-OH-ara-cytidine | Fail | Fail | NT | NT | NT | NT | NT | NT |
| 2'-OH-ara-uridine | Fail | Fail | NT | NT | NT | NT | NT | NT |
| 5-Br-Uridine | Pass | Pass | + | + | + | + | + | |
| 5-(2-carbo-methoxyvinyl) Uridine | Pass | Pass | − | − | +/− | − | | |

TABLE 127-continued

| | | | | | | | | |
|---|---|---|---|---|---|---|---|---|
| | | | Non-Naturally Occurring | | | | | |
| Common Name | IVT (Luc) | IVT (G-CSF) | Protein (Luc; HeLa) | Protein (G-CSF; HeLa) | Protein (G-CSF; PBMC) | Cytokines (G-CSF; PBMC) | In Vivo Protein (Luc) | In Vivo Protein (G-CSF) |
| 5-[3-(1-E-Propenylamino) Uridine (aka Chem 5) | Pass | Pass | – | + | + | – | | |
| N6-(19-Amino-penta-oxanonadecyl) A | Fail | Fail | NT | NT | NT | NT | NT | NT |
| 2-Dimethylamino guanosine | Fail | Fail | NT | NT | NT | NT | NT | NT |
| 6-Aza-cytidine | Fail | Fail | NT | NT | NT | NT | NT | NT |
| a-Thio-cytidine | Pass | Pass | + | + | +/– | +++ | NT | NT |
| Pseudo-isocytidine | NT | NT | NT | NT | NT | NT | NT | NT |
| 5-Iodo-uridine | NT | NT | NT | NT | NT | NT | NT | NT |
| a-Thio-uridine | NT | NT | NT | NT | NT | NT | NT | NT |
| 6-Aza-uridine | NT | NT | NT | NT | NT | NT | NT | NT |
| Deoxy-thymidine | NT | NT | NT | NT | NT | NT | NT | NT |
| a-Thio guanosine | NT | NT | NT | NT | NT | NT | NT | NT |
| 8-Oxo-guanosine | NT | NT | NT | NT | NT | NT | NT | NT |
| O6-Methyl-guanosine | NT | NT | NT | NT | NT | NT | NT | NT |
| 7-Deaza-guanosine | NT | NT | NT | NT | NT | NT | NT | NT |
| 6-Chloro-purine | NT | NT | NT | NT | NT | NT | NT | NT |
| a-Thio-adenosine | NT | NT | NT | NT | NT | NT | NT | NT |
| 7-Deaza-adenosine | NT | NT | NT | NT | NT | NT | NT | NT |
| 5-iodo-cytidine | NT | NT | NT | NT | NT | NT | NT | NT |

In Table 128, the protein production of HeLa is judged by "+," "+/–" and "–"; when referring to G-CSF PBMC "++++" means greater than 6,000 pg/ml G-CSF, "+++" means greater than 3,000 pg/ml G-CSF, "++" means greater than 1,500 pg/ml G-CSF, "+" means greater than 300 pg/ml G-CSF, "+/–" means 150-300 pg/ml G-CSF and the background was about 110 pg/ml; when referring to cytokine PBMC "++++" means greater than 1,000 pg/ml interferon-alpha (IFN-alpha), "+++" means greater than 600 pg/ml IFN-alpha, "++" means greater than 300 pg/ml IFN-alpha, "+" means greater than 100 pg/ml IFN-alpha, "–" means less than 100 pg/ml and the background was about 70 pg/ml; "WT" refers to the wild type T7 polymerase, "MT" refers to mutant T7 polymerase (Durascribe® T7 Transcription kit (Cat. No. DS010925) (Epicentre®, Madison, Wis.) and "NT" means not tested.

TABLE 128

| | | | | | | | | | |
|---|---|---|---|---|---|---|---|---|---|
| | | | | Combination Chemistry | | | | | |
| Cytidine analog | Uridine analog | Purine | IVT Luc | IVT (G-CSF) | Protein (Luc; HeLa) | Protein (G-CSF; HeLa) | Protein (G-CSF; PBMC) | Cytokines (G-CSF; PBMC) | In Vivo Protein (Luc) |
| N4-acetylcytidine | pseudouridine | A, G | Pass WT | Pass WT | + | + | NT | NT | + |
| N4-acetylcytidine | N1-methyl-pseudouridine | A, G | Pass WT | Pass WT | + | + | NT | NT | + |
| 5-methylcytidine | 5-methoxyuridine | A, G | Pass WT | Pass WT | + | + | NT | NT | + |
| 5-methylcytidine | 5-bromouridine | A, G | Pass WT | Pass WT | Not Done | + | NT | NT | |
| 5-methylcytidine | 5-methyluridine | A, G | Pass WT | Pass WT | + | + | NT | NT | + |
| 5-methylcytidine | 50% 2-thiouridine; 50% uridine | A, G | Pass WT | Pass WT | + | NT | NT | NT | + |

TABLE 128-continued

Combination Chemistry

| Cytidine analog | Uridine analog | Purine | IVT Luc | IVT (G-CSF) | Protein (Luc; HeLa) | Protein (G-CSF; HeLa) | Protein (G-CSF; PBMC) | Cytokines (G-CSF; PBMC) | In Vivo Protein (Luc) |
|---|---|---|---|---|---|---|---|---|---|
| 5-methylcytidine | 100% 2-thiouridine | A, G | Pass WT | Pass WT | – | + | NT | NT | |
| 5-methylcytidine | pseudouridine | A, G | Pass WT | Pass WT | + | + | ++ | + | + |
| 5-methylcytidine | N1-methyl-pseudouridine | A, G | Pass WT | Pass WT | + | + | ++++ | – | + |
| N4-acetylcytidine | 2-thiouridine | A, G | Not Done | Pass WT | Not Done | + | NT | NT | NT |
| N4-acetylcytidine | 5-bromouridine | A, G | Not Done | Pass WT | Not Done | + | NT | NT | NT |
| N4-acetylcytidine | 2 Fluorouridine triphosphate | A, G | Pass | Pass | – | + | NT | NT | NT |
| 5-methylcytidine | 2 Fluorouridine triphosphate | A, G | Pass | Pass | – | + | NT | NT | NT |
| 2 Fluorocytosine triphosphate | pseudouridine | A, G | Pass | Pass | – | + | NT | NT | NT |
| 2 Fluorocytosine triphosphate | N1-methyl-pseudouridine | A, G | Pass | Pass | – | +/– | NT | NT | NT |
| 2 Fluorocytosine triphosphate | 2-thiouridine | A, G | Pass | Pass | – | – | NT | NT | NT |
| 2 Fluorocytosine triphosphate | 5-bromouridine | A, G | Pass | Pass | – | +/– | NT | NT | NT |
| 2 Fluorocytosine triphosphate | 2 Fluorouridine triphosphate | A, G | Pass | Pass | – | +/– | NT | NT | NT |
| 5-methylcytidine | uridine | A, 2 Fluoro GTP | Pass | Pass | – | – | NT | NT | NT |
| 5-methylcytidine | pseudouridine | A, 2 Fluoro GTP | Pass | Pass | – | – | NT | NT | NT |
| 5-methylcytidine | N1-methyl-pseudouridine | A, 2 Fluoro GTP | Pass | Pass | – | +/– | NT | NT | NT |
| 2 Fluorocytosine triphosphate | pseudouridine | A, 2 Fluoro GTP | Pass | Pass | – | +/– | NT | NT | NT |
| 2 Fluorocytosine triphosphate | N1-methyl-pseudouridine | A, 2 Fluoro GTP | Pass | Pass | – | – | NT | NT | NT |

Example 79

2'Fluoro Chemistries in PBMC

The ability of G-CSF modified mRNA (mRNA sequence shown in SEQ ID NO: 33897; polyA tail of approximately 160 nucleotides not shown in sequence; 5'cap, Cap1) to trigger innate an immune response was determined by measuring interferon-alpha (IFN-alpha) and tumor necrosis factor-alpha (TNF-alpha) production. Use of in vitro PBMC cultures is an accepted way to measure the immunostimulatory potential of oligonucleotides (Robbins et al., Oligonucleotides 2009 19:89-102) and transfection methods are described herein. Shown in Table 129 are the average from 2 or 3 separate PBMC donors of the interferon-alpha (IFN-alpha) and tumor necrosis factor alpha (TNF-alpha) production over time as measured by specific ELISA. Controls of R848, P(I)P(C), LPS and Lipofectamine 2000 (L2000) were also analyzed.

With regards to innate immune recognition, while both modified mRNA chemistries largely prevented IFN-alpha and TNF-alpha production relative to positive controls (R848, P(I)P(C)), 2' fluoro compounds reduce IFN-alpha and TNF-alpha production even lower than other combinations and N4-acetylcytidine combinations raised the cytokine profile.

TABLE 129

IFN-alpha and TNF-alpha

| | IFN-alpha: 3 Donor Average (pg/ml) | TNF-alpha: 2 Donor Average (pg/ml) |
|---|---|---|
| L2000 | 1 | 361 |
| P(I)P(C) | 482 | 544 |
| R848 | 45 | 8,235 |
| LPS | 0 | 6,889 |
| N4-acetylcytidine/pseudouridine | 694 | 528 |
| N4-acetylcytidine/N1-methyl-pseudouridine | 307 | 283 |
| 5-methylcytidine/5-methoxyuridine | 0 | 411 |
| 5-methylcytidine/5-bromouridine | 0 | 270 |
| 5-methylcytidine/5-methyluridine | 456 | 428 |

TABLE 129-continued

IFN-alpha and TNF-alpha

|  | IFN-alpha: 3 Donor Average (pg/ml) | TNF-alpha: 2 Donor Average (pg/ml) |
|---|---|---|
| 5-methylcytidine/2-thiouridine | 274 | 277 |
| N4-acetylcytidine/2-thiouridine | 0 | 285 |
| N4-acetylcytidine/5-bromouridine | 44 | 403 |
| 5-methylcytidine/pseudouridine | 73 | 332 |
| 5-methylcytidine/N1-methyl-pseudouridine | 31 | 280 |
| N4-acetylcytidine/2'fluorouridine triphosphate | 35 | 32 |
| 5-methylcytodine/2'fluorouridine triphosphate | 24 | 0 |
| 2'fluorocytidine triphosphate/N1-methyl-pseudouridine | 0 | 11 |
| 2'fluorocytidine triphosphate/2-thiouridine | 0 | 0 |
| 2'fluorocytidine/triphosphate5-bromouridine | 12 | 2 |
| 2'fluorocytidine triphosphate/2'fluorouridine triphosphate | 11 | 0 |
| 2'fluorocytidine triphosphate/5-methylcytidine | 14 | 23 |
| 2'fluorocytidine triphosphate/5-methylcytidine/pseudouridine | 6 | 21 |
| 2'fluorocytidine triphosphate/5-methylcytidine/N1-methyl-pseudouridine | 3 | 15 |
| 2'fluorocytidine triphosphate/pseudouridine | 0 | 4 |
| 2'fluorocytidine triphosphate/N1-methyl-pseudouridine | 6 | 20 |
| 5-methylcytidine/pseudouridine | 82 | 18 |
| 5-methylcytidine/N1-methyl-pseudouridine | 35 | 3 |

Example 80

Modified mRNA with a Tobacco Etch Virus 5'UTR

A 5' untranslated region (UTR) may be provided as a flanking region. Multiple 5' UTRs may be included in the flanking region and may be the same or of different sequences. Any portion of the flanking regions, including none, may be codon optimized and any may independently contain one or more different structural or chemical modifications, before and/or after codon optimization.

The 5' UTR may comprise the 5'UTR from the tobacco etch virus (TEV). Variants of 5' UTRs may be utilized wherein one or more nucleotides are added or removed to the termini, including A, T, C or G.

Example 81

Expression of PLGA Formulated mRNA

A. Synthesis and Characterization of Luciferase PLGA Microspheres

Luciferase mRNA (mRNA sequence shown in SEQ ID NO: 33907; polyA tail of approximately 140 nucleotides not shown in sequence; 5'cap, Cap1) fully modified with 5-methylcytosine and N1-methyl pseudouridine, modified with 25% of uridine replaced with 2-thiouridine and 25% of cytosine replaced with 5-methylcytosine, fully modified with N1-methyl pseudouridine, or fully modified with pseudouridine was reconstituted in 1×TE buffer and then formulated in PLGA microspheres. PLGA microspheres were synthesized using the water/oil/water double emulsification methods known in the art using PLGA-ester cap (Lactel, Cat#B6010-2, inherent viscosity 0.55-0.75, 50:50 LA:GA), polyvinylalcohol (PVA) (Sigma, Cat#348406-25G, MW 13-23 k) dichloromethane and water. Briefly, 0.4 ml of mRNA in TE buffer at 4 mg/ml (W1) was added to 2 ml of PLGA dissolved in dichloromethane (DCM) (O1) at a concentration of 200 mg/ml of PLGA. The W1/O1 emulsion was homogenized (IKA Ultra-Turrax Homogenizer, T18) for 30 seconds at speed 5 (~19,000 rpm). The W1/O1 emulsion was then added to 250 ml 1% PVA (W2) and homogenized for 1 minute at speed 5 (~19,000 rpm). Formulations were left to stir for 3 hours, then passed through a 100 µm nylon mesh strainer (Fisherbrand Cell Strainer, Cat #22-363-549) to remove larger aggregates, and finally washed by centrifugation (10 min, 9,250 rpm, 4° C.). The supernatant was discarded and the PLGA pellets were resuspended in 5-10 ml of water, which was repeated 2×. After washing and resuspension with water, 100-200 µl of a PLGA microspheres sample was used to measure particle size of the formulations by laser diffraction (Malvern Mastersizer2000). The washed formulations were frozen in liquid nitrogen and then lyophilized for 2-3 days.

After lyophilization, ~10 mg of PLGA MS were weighed out in 2 ml eppendorf tubes and deformulated by adding 1 ml of DCM and letting the samples shake for 2-6 hrs. The mRNA was extracted from the deformulated PLGA micropsheres by adding 0.5 ml of water and shaking the sample overnight. Unformulated luciferase mRNA in TE buffer (unformulated control) was spiked into DCM and went through the deformulation process (deformulation control) to be used as controls in the transfection assay. The encapsulation efficiency, weight percent loading and particle size are shown in Table 130. Encapsulation efficiency was calculated as mg of mRNA from deformulation of PLGA microspheres divided by the initial amount of mRNA added to the formulation. Weight percent loading in the formulation was calculated as mg of mRNA from deformulation of PLGA microspheres divided by the initial amount of PLGA added to the formulation.

TABLE 130

PLGA Characteristics

| Chemical Modifications | Sample ID | Encapsulation Efficiency (%) | Theoretical mRNA Loading (wt %) | Actual mRNA Loading (wt %) | Particle Size (D50, um) |
|---|---|---|---|---|---|
| Fully modified with 5-methylcytosine and N1-methyl pseudouridine | 43-66A | 45.8 | 0.4 | 0.18 | 33.4 |
|  | 43-66B | 29.6 |  | 0.12 | 27.7 |
|  | 43-66C | 25.5 |  | 0.10 | 27.1 |
| 25% of uridine replaced with 2-thiouridine and 25% of cytosine replaced with 5-methylcytosine | 43-67A | 34.6 | 0.4 | 0.14 | 29.9 |
|  | 43-67B | 22.8 |  | 0.09 | 30.2 |
|  | 43-67C | 23.9 |  | 0.10 | 25.1 |

TABLE 130-continued

PLGA Characteristics

| Chemical Modifications | Sample ID | Encapsulation Efficiency (%) | Theoretical mRNA Loading (wt %) | Actual mRNA Loading (wt %) | Particle Size (D50, um) |
|---|---|---|---|---|---|
| Fully modified with N1-methyl pseudouridine | 43-69A | 55.8 | 0.4 | 0.22 | 40.5 |
|  | 43-69B | 31.2 |  | 0.12 | 41.1 |
|  | 43-69C | 24.9 |  | 0.10 | 46.1 |
| Fully modified with pseudouridine | 43-68-1 | 49.3 | 0.4 | 0.20 | 34.8 |
|  | 43-68-2 | 37.4 |  | 0.15 | 35.9 |
|  | 43-68-3 | 45.0 |  | 0.18 | 36.5 |

B. Protein Expression of Modified mRNA Encapsulated in PLGA Microspheres

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37° C. in a 5% CO2 atmosphere overnight. The next day, 83 ng of the deformulated luciferase mRNA PLGA microsphere samples, deformulated luciferase mRNA control (Deform control), or unformulated luciferase mRNA control (Unfomul control) was diluted in a 10 ul final volume of OPTI-MEM (LifeTechnologies, Grand Island, N.Y.). Lipofectamine 2000 (LifeTechnologies, Grand Island, N.Y.) was used as a transfection reagent and 0.2 ul was diluted in a 10 ul final volume of OPTI-MEM. After 5 min of incubation at room temperature, both solutions were combined and incubated an additional 15 min at room temperature. Then 20 ul of the combined solution was added to 100 ul of cell culture medium containing the HeLa cells. The plates were then incubated as described before.

After an 18 to 22 hour incubation, cells expressing luciferase were lysed with 100 ul Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The background signal of the plates without reagent was about 200 relative light units per well. The plate reader was a BioTek Synergy H1 (BioTek, Winooski, Vt.).

Cells were harvested and the bioluminescence (in relative light units, RLU) for each sample is shown in Table 131. Transfection of these samples confirmed that the varied chemistries of luciferase mRNA is still able to express luciferase protein after PLGA microsphere formulation.

TABLE 131

Chemical Modifications

| Chemical Modifications | Sample ID | Biolum. (RLU) |
|---|---|---|
| Fully modified with 5-methylcytosine and N1-methyl-pseudouridine | Deform contol | 164266.5 |
|  | Unformul control | 113714 |
|  | 43-66A | 25174 |
|  | 43-66B | 25359 |
|  | 43-66C | 20060 |
| 25% of uridine replaced with 2-thiouridine and 25% | Deform contol | 90816.5 |
|  | Unformul control | 129806 |
|  | 43-67A | 38329.5 |

TABLE 131-continued

Chemical Modifications

| Chemical Modifications | Sample ID | Biolum. (RLU) |
|---|---|---|
| of cytosine replaced with 5-methylcytosine | 43-67B | 8471.5 |
|  | 43-67C | 10991.5 |
| Fully modified with N1-methyl-pseudouridine | Deform contol | 928093.5 |
|  | Unformul control | 1512273.5 |
|  | 43-69A | 1240299.5 |
|  | 43-69B | 748667.5 |
|  | 43-69C | 1193314 |
| Fully modified with pseudouridine | Deform contol | 154168 |
|  | Unformul control | 151581 |
|  | 43-68-1 | 120974.5 |
|  | 43-68-2 | 107669 |
|  | 43-68-3 | 97226 |

Example 82

In Vitro Studies of Factor IX

A. Serum-Free Media

Human Factor IX mRNA (mRNA sequence shown in SEQ ID NO: 33901; polyA tail of approximately 160 nucleotides not shown in sequence; 5'cap, Cap1; fully modified with 5-methylcytosine and pseudouridine) was transfected in serum-free media. The cell culture supernatant was collected and subjected to trypsin digestion before undergoing 2-dimensional HPLC separation of the peptides. Matrix-assisted laser desorption/ionization was used to detect the peptides. 8 peptides were detected and 7 of the detected peptides are unique to Factor IX. These results indicate that the mRNA transfected in the serum-free media was able to express full-length Factor IX protein.

B. Human Embryonic Kidney (HEK) 293A Cells 250 ng of codon optimized Human Factor IX mRNA (mRNA sequence shown in SEQ ID NO: 33901; fully modified with 5-methylcytosine and pseudouridine; polyA tail of approximately 160 nucleotides not shown in sequence; 5'cap, Cap1) was transfected into HEK 293A cells (150,000 cells/well) using Lipofectamine 2000 in DMEM in presence of 10% FBS. The transfection complexes were removed 3 hours after transfection. Cells were harvested at 3, 6, 9, 12, 24, 48 and 72 hours after transfection. Total RNA was isolated and used for cDNA synthesis. The cDNA was subjected to analysis by quantitative Real-Time PCR using codon optimized Factor IX specific primer set. Human hypoxanthine phosphoribosyltransfersase 1 (HPRT) level was used for normalization. The data is plotted as a percent of detectable mRNA considering the mRNA level as 100% at the 3 hour time point. The half-life of Factor IX modified mRNA fully modified with 5-methylcytosine and pseudouridine in human embryonic kidney 293 (HEK293) cells is about 8-10 hours.

Example 83

Saline Formulation: Subcutaneous Administration

Human G-CSF modified mRNA (mRNA sequence shown in SEQ ID NO: 33897; polyA tail of approximately 160 nucleotides not shown in sequence; 5'cap, Cap1; fully modified with 5-methylcytosine and pseudouridine) and human EPO modified mRNA (mRNA sequence shown in SEQ ID NO: 33900; polyA tail of approximately 160 nucleotides not shown in sequence; 5'cap, Cap1; fully modified with 5-methylcytosine and pseudouridine), were formulated in saline and delivered to mice via intramuscular (IM) injection at a dose of 100 ug.

Controls included Luciferase (mRNA sequence shown in SEQ ID NO: 33907; polyA tail of approximately 160 nucleotides not shown in sequence; 5'cap, Cap1; fully modified with 5-methylcytosine and pseudouridine)) or the formulation buffer (F.Buffer). The mice were bled at 13 hours after the injection to determine the concentration of the human polypeptide in serum in pg/mL. (G-CSF groups measured human G-CSF in mouse serum and EPO groups measured human EPO in mouse serum). The data are shown in Table 132.

mRNA degrades rapidly in serum in the absence of formulation suggesting the best method to deliver mRNA to last longer in the system is by formulating the mRNA. As shown in Table 132, mRNA can be delivered subcutaneously using only a buffer formulation.

TABLE 132

Dosing Regimen

| Group | Treatment | Dose Vol. (μl/mouse) | Dosing Vehicle | Average Protein Product pg/mL, serum |
| --- | --- | --- | --- | --- |
| G-CSF | G-CSF | 100 | F. buffer | 45 |
| G-CSF | Luciferase | 100 | F. buffer | 0 |
| G-CSF | F. buffer | 100 | F. buffer | 2.2 |
| EPO | EPO | 100 | F. buffer | 72.03 |
| EPO | Luciferase | 100 | F. buffer | 26.7 |
| EPO | F. buffer | 100 | F. buffer | 13.05 |

Example 84

Intravitreal Delivery mCherry modified mRNA (mRNA sequence shown in SEQ ID NO: 33898; polyA tail of approximately 160 nucleotides not shown in sequence; 5'cap, Cap1; fully modified with 5-methylcytosine and pseudouridine) and luciferase modified mRNA (mRNA sequence shown in SEQ ID NO: 33907; polyA tail of approximately 160 nucleotides not shown in sequence; 5'cap, Cap1; fully modified with 5-methylcytosine and pseudouridine) formulated in saline was delivered intravitreally in rats as described in Table 133. The sample was compared against a control of saline only delivered intravitreally.

TABLE 133

Dosing Chart

| Group No. | Dose Level (μg modified RNA/eye) | Dose volume (μL/eye) | Treatment Right Eye (OD) | Treatment Left Eye (OS) |
| --- | --- | --- | --- | --- |
| Control | 0 | 5 | Delivery buffer only | Delivery buffer only |
| Modified RNA in delivery buffer | 10 | 5 | mCherry | Luciferase |

The formulation will be administered to the left or right eye of each animal on day 1 while the animal is anesthetized. On the day prior to administration gentamicin ophthalmic ointment or solution was applied to both eyes twice. The gentamicin ophthalmic ointment or solution was also applied immediately following the injection and on the day following the injection. Prior to dosing, mydriatic drops (1% tropicamide and/or 2.5% phenylephrine) are applied to each eye.

18 hours post dosing the eyes receiving the dose of mCherry and delivery buffer are enucleated and each eye was separately placed in a tube containing 10 mL 4% paraformaldehyde at room temperature for overnight tissue fixation. The following day, eyes will be separately transferred to tubes containing 10 mL of 30% sucrose and stored at 21° C. until they were processed and sectioned. The slides prepared from different sections were evaluated under F-microscopy. Positive expression was seen in the slides prepared with the eyes administered mCherry modified mRNA and the control showed no expression.

Example 85

In Vivo Cytokine Expression Study

Mice were injected intramuscularly with 200 ug of G-CSF modified mRNA (mRNA sequence shown in SEQ ID NO: 33897; polyA tail of approximately 160 nucleotides not shown in sequence) which was unmodified with a 5'cap, Cap1 (unmodified), fully modified with 5-methylcytosine and pseudouridine and a 5'cap, Cap1 (Gen1) or fully modified with 5-methylcytosine and N1-methylpseudouridine and a 5'cap, Cap1 (Gen2 cap) or no cap (Gen2 uncapped). Controls of R-848, 5% sucrose and untreated mice were also analyzed. After 8 hours serum was collected from the mice and analyzed for interferon-alpha (IFN-alpha) expression. The results are shown in Table 134.

TABLE 134

IFN-alpha Expression

| Formulation | IFN-alpha (pg/ml) |
| --- | --- |
| G-CSF unmodified | 67.012 |
| G-CSF Gen1 | 8.867 |
| G-CSF Gen2 cap | 0 |
| G-CSF Gen2 uncapped | 0 |
| R-848 | 40.971 |
| 5% sucrose | 1.493 |
| Untreated | 0 |

Example 86

In Vitro Expression of VEGF Modified mRNA

HEK293 cells were transfected with modified mRNA (mmRNA) VEGF-A (mRNA sequence shown in SEQ ID NO:

33910; polyA tail of approximately 160 nucleotides not shown in sequence; 5'cap, Cap1; fully modified with 5-methylcytosine and pseudouridine) which had been complexed with Lipofectamine2000 from Invitrogen (Carlsbad, Calif.) at the concentration shown in Table 135. The protein expression was detected by ELISA and the protein (pg/ml) is shown in Table 135.

TABLE 135

Protein Expression

| | Amount Transfected | | | | | | |
|---|---|---|---|---|---|---|---|
| | 10 ng | 2.5 ng | 625 pg | 156 pg | 39 pg | 10 pg | 2 pg | 610 fg |
| Protein (pg/ml) | 10495 | 10038 | 2321.23 | 189.6 | 0 | 0 | 0 | 0 |

Example 87

In Vitro Screening in HeLa Cells of GFP

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37° C. in 5% $CO_2$ atmosphere overnight. Next day, 37.5 ng or 75 ng of Green Fluorescent protein (GFP) modified RNA (mRNA sequence shown in SEQ ID NO: 33909; polyA tail of approximately 160 nucleotides not shown in sequence; 5'cap, Cap1) with the chemical modification described in Table 136, were diluted in 10 ul final volume of OPTI-MEM (LifeTechnologies, Grand Island, N.Y.). Lipofectamine 2000 (LifeTechnologies, Grand Island, N.Y.) was used as transfection reagent and 0.2 ul were diluted in 10 ul final volume of OPTI-MEM. After 5 minutes of incubation at room temperature, both solutions were combined and incubated an additional 15 minute at room temperature. Then the 20 ul combined solution was added to the 100 ul cell culture medium containing the HeLa cells and incubated at room temperature.

After an 18 to 22 hour incubation cells expressing luciferase were lysed with 100 ul of Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The median fluorescence intensity (MFI) was determined for each chemistry and is shown in Table 136.

These results demonstrate that GFP fully modified with N1-methylpseudouridine and 5-methylcytosine produces more protein in HeLa cells compared to the other chemistry. Additionally the higher dose of GFP administered to the cells resulted in the highest MFI value.

TABLE 136

| | Mean Fluorescence Intensity | |
|---|---|---|
| Chemistry | 37.5 ng MFI | 75 ng MFI |
| No modifications | 97400 | 89500 |
| 5-methylcytosine/pseudouridine | 324000 | 715000 |
| 5-methylcytosine/N1-methyl-pseudouridine | 643000 | 1990000 |

Example 88

Homogenization

Different luciferase mRNA solutions (as described in Table 137 where "X" refers to the solution containing that component) (mRNA sequence shown in SEQ ID NO: 33907; polyA tail of approximately 160 nucleotides not shown in sequence; 5'cap, Cap1; fully modified with 5-methylcytosine and pseudouridine) were evaluated to test the percent yield of the different solutions, the integrity of the mRNA by bioanalyzer, and the protein expression of the mRNA by in vitro transfection. The mRNA solutions were prepared in water, 1×TE buffer at 4 mg/ml as indicated in Table 137, and added to either dichloromethane (DCM) or DCM containing 200 mg/ml of poly(lactic-co-glycolic acid) (PLGA) (Lactel, Cat#B6010-2, inherent viscosity 0.55-0.75, 50:50 LA:GA) to achieve a final mRNA concentration of 0.8 mg/ml. The solutions requiring homogenization were homogenized for 30 seconds at speed 5 (approximately 19,000 rpm) (IKA Ultra-Turrax Homogenizer, T18). The mRNA samples in water, dichloromethane and poly(lactic-co-glycolic acid) (PLGA) were not recoverable (NR). All samples, except the NR samples, maintained integrity of the mRNA as determined by bioanalyzer (Bio-rad Experion).

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37° C. in a 5% CO2 atmosphere overnight. The next day, 250 ng of luciferase mRNA from the recoverable samples was diluted in a 10 ul final volume of OPTI-MEM (LifeTechnologies, Grand Island, N.Y.). Lipofectamine 2000 (LifeTechnologies, Grand Island, N.Y.) was used as a transfection reagent and 0.2 ul was diluted in a 10 ul final volume of OPTI-MEM. After 5 minutes of incubation at room temperature, both solutions were combined and incubated an additional 15 minutes at room temperature. Then 20 ul of the combined solution was added to 100 ul of cell culture medium containing the HeLa cells. The plates were then incubated as described before. Controls luciferase mRNA (luciferase mRNA formulated in saline) (Control) and untreated cells (Untreat.) were also evaluated. Cells were harvested and the bioluminescence average (in photons/second) (biolum. (p/s)) for each signal is also shown in Table 137. The recoverable samples all showed activity of luciferase mRNA when analyzed.

After an 18 to 22 hour incubation, cells expressing luciferase were lysed with 100 ul Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The background signal of the plates without reagent was about 200 relative light units per well. The plate reader was a BioTek Synergy H1 (BioTek, Winooski, Vt.).

Cells were harvested and the bioluminescence average (in relative light units, RLU) (biolum. (RLU)) for each signal is also shown in Table 137. The recoverable samples all showed activity of luciferase mRNA when analyzed.

TABLE 137

Solutions

| Solution No. | Water | 1× TE Buffer | DCM | DCM/ PLGA | Homog- enizer | Yield (%) | Biolum. (RLU) |
|---|---|---|---|---|---|---|---|
| 1 | X | | | | | 96 | 5423780 |
| 2 | | X | | | X | 95 | 4911950 |
| 3 | X | | | | X | 92 | 2367230 |
| 4 | | X | | | X | 90 | 4349410 |
| 5 | X | | X | | X | 66 | 4145340 |
| 6 | | X | X | | X | 71 | 3834440 |
| 7 | X | | | X | X | NR | n/a |
| 8 | | X | | X | X | 24 | 3182080 |
| 9 | X | | | X | | NR | n/a |
| 10 | | X | | X | | 79 | 3276800 |
| 11 | X | | X | | | 79 | 5563550 |
| 12 | | X | X | | | 79 | 4919100 |
| Control | | | | | | | 2158060 |
| Untreat. | | | | | | | 3530 |

Example 89

TE Buffer and Water Evaluation

Luciferase mRNA (mRNA sequence shown in SEQ ID NO: 33907; polyA tail of approximately 160 nucleotides not shown in sequence; 5'cap, Cap1; fully modified with 5-methylcytosine and pseudouridine) was reconstituted in water or TE buffer as outlined in Table 138 and then formulated in PLGA microspheres. PLGA microspheres were synthesized using the water/oil/water double emulsification methods known in the art using PLGA (Lactel, Cat#B6010-2, inherent viscosity 0.55-0.75, 50:50 LA:GA), polyvinylalcohol (PVA) (Sigma, Cat#348406-25G, MW 13-23 k) dichloromethane and water. Briefly, 0.2 to 0.6 ml of mRNA in water or TE buffer at a concentration of 2 to 6 mg/ml (W1) was added to 2 ml of PLGA dissolved in dichloromethane (DCM) (O1) at a concentration of 100 mg/ml of PLGA. The W1/O1 emulsion was homogenized (IKA Ultra-Turrax Homogenizer, T18) for 30 seconds at speed 5 (~19,000 rpm). The W1/O1 emulsion was then added to 250 ml 1% PVA (W2) and homogenized for 1 minute at speed 5 (~19,000 rpm). Formulations were left to stir for 3 hours, then passed through a 100 μm nylon mesh strainer (Fisherbrand Cell Strainer, Cat #22-363-549) to remove larger aggregates, and finally washed by centrifugation (10 min, 9,250 rpm, 4° C.). The supernatant was discarded and the PLGA pellets were resuspended in 5-10 ml of water, which was repeated 2×. The washed formulations were frozen in liquid nitrogen and then lyophilized for 2-3 days. After lyophilization, ~10 mg of PLGA MS were weighed out in 2 ml eppendorf tubes and deformulated by adding 1 ml of DCM and letting the samples shake for 2-6 hrs. mRNA was extracted from the deformulated PLGA micropsheres by adding 0.5 ml of water and shaking the sample overnight. Unformulated luciferase mRNA in water or TE buffer (deformulation controls) was spiked into DCM and went through the deformulation process to be used as controls in the transfection assay.

The day before transfection, 20,000 HeLa cells (ATCC no. CCL-2; Manassas, Va.) were harvested by treatment with Trypsin-EDTA solution (LifeTechnologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37° C. in a 5% CO2 atmosphere overnight. The next day, 100 ng of the deformulated luciferase mRNA samples was diluted in a 10 ul final volume of OPTI-MEM (LifeTechnologies, Grand Island, N.Y.). Lipofectamine 2000 (LifeTechnologies, Grand Island, N.Y.) was used as a transfection reagent and 0.2 ul was diluted in a 10 ul final volume of OPTI-MEM. After 5 minutes of incubation at room temperature, both solutions were combined and incubated an additional 15 minutes at room temperature. Then 20 ul of the combined solution was added to 100 ul of cell culture medium containing the HeLa cells. The plates were then incubated as described before.

After 18 to 22 hour incubation, cells expressing luciferase were lysed with 100 ul Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The background signal of the plates without reagent was about 200 relative light units per well. The plate reader was a BioTek Synergy H1 (BioTek, Winooski, Vt.). To determine the activity of the luciferase mRNA from each formulation, the relative light units (RLU) for each formulation was divided by the RLU of the appropriate mRNA deformulation control (mRNA in water or TE buffer). Table 138 shows the activity of the luciferase mRNA. The activity of the luciferase mRNA in the PLGA microsphere formulations (Form.) was substantially improved by formulating in TE buffer versus water.

TABLE 138

Formulations

| Form. | mRNA conc. (mg/ml) | W1 Solvent volume (ul) | Total mRNA (ug) | Theoretical mRNA Loading (wt %) | Actual mRNA Loading (wt %) | W1 Solvent | Activity (% of deform. control) |
|---|---|---|---|---|---|---|---|
| PLGA A | 4 | 400 | 1600 | 0.80 | 0.14 | Water | 12.5% |
| PLGA B | 4 | 200 | 800 | 0.40 | 0.13 | Water | 1.3% |
| PLGA C | 4 | 600 | 2400 | 1.20 | 0.13 | Water | 12.1% |
| PLGA D | 2 | 400 | 800 | 0.40 | 0.07 | Water | 1.3% |
| PLGA E | 6 | 400 | 2400 | 1.20 | 0.18 | TE Buffer | 38.9% |
| PLGA F | 4 | 400 | 1600 | 0.80 | 0.16 | TE Buffer | 39.7% |
| PLGA G | 4 | 400 | 1600 | 0.80 | 0.10 | TE Buffer | 26.6% |

Example 90

Chemical Modifications on mRNA

The day before transfection, 20,000 HeLa cells (ATCC no. CCL-2; Manassas, Va.) were harvested by treatment with Trypsin-EDTA solution (Life Technologies, Grand Island, N.Y.) and seeded in a total volume of 100 ul EMEM medium (supplemented with 10% FCS and 1× Glutamax) per well in a 96-well cell culture plate (Corning, Manassas, Va.). The cells were grown at 37° C. in 5% $CO_2$ atmosphere overnight. The next day, 83 ng of Luciferase modified RNA (mRNA sequence shown SEQ ID NO: 33907; polyA tail of approximately 140 nucleotides not shown in sequence; 5'cap, Cap1) with the chemical modification described in Table 139, were diluted in 10 ul final volume of OPTI-MEM (LifeTechnologies, Grand Island, N.Y.). Lipofectamine 2000 (LifeTechnologies, Grand Island, N.Y.) was used as transfection reagent and 0.2 ul were diluted in 10 ul final volume of OPTI-MEM. After 5 minutes of incubation at room temperature, both solutions were combined and incubated an additional 15 minute at room temperature. Then the 20 ul combined solution was added to the 100 ul cell culture medium containing the HeLa cells and incubated at room temperature.

After 18 to 22 hours of incubation cells expressing luciferase were lysed with 100 ul of Passive Lysis Buffer (Promega, Madison, Wis.) according to manufacturer instructions. Aliquots of the lysates were transferred to white opaque polystyrene 96-well plates (Corning, Manassas, Va.) and combined with 100 ul complete luciferase assay solution (Promega, Madison, Wis.). The lysate volumes were adjusted or diluted until no more than 2 mio relative light units (RLU) per well were detected for the strongest signal producing samples and the RLUs for each chemistry tested are shown in Table 139. The plate reader was a BioTek Synergy H1 (BioTek, Winooski, Vt.). The background signal of the plates without reagent was about 200 relative light units per well.

TABLE 139

Chemical Modifications

| Sample | RLU |
| --- | --- |
| Untreated | 336 |
| Unmodified Luciferase | 33980 |
| 5-methylcytosine and pseudouridine | 1601234 |
| 5-methylcytosine and N1-methyl-pseudouridine | 421189 |
| 25% cytosines replaced with 5-methylcytosine and 25% of uridines replaced with 2-thiouridine | 222114 |
| N1-methyl-pseudouridine | 3068261 |
| Pseudouridine | 140234 |
| N4-Acetylcytidine | 1073251 |
| 5-methoxyuridine | 219657 |
| 5-Bromouridine | 6787 |
| N4-Acetylcytidine and N1-methyl-pseudouridine | 976219 |
| 5-methylcytosine and 5-methoxyuridine | 66621 |
| 5-methylcytosine and 2'fluorouridine | 11333 |

Example 91

Intramuscular and Subcutaneous Administration of Modified mRNA

Luciferase modified mRNA (mRNA sequence shown in SEQ ID NO: 33907; polyA tail of approximately 140 nucleotides not shown in sequence; 5'cap, Cap1) fully modified with 5-methylcytosine and pseudouridine (5mC/pU), fully modified with 5-methylcytosine and N1-methyl-pseudouridine (5mC/N1mpU), fully modified with pseudouridine (pU), fully modified with N1-methyl-pseudouridine (N1mpU) or modified where 25% of the cytosines replaced with 5-methylcytosine and 25% of the uridines replaced with 2-thiouridine (5mC/s2U) formulated in PBS (pH 7.4) was administered to Balb-C mice intramuscularly or subcutaneously at a dose of 2.5 mg/kg. The mice were imaged at 2 hours, 8 hours, 24 hours, 48 hours, 72 hours, 96 hours, 120 hours and 144 hours for intramuscular delivery and 2 hours, 8 hours, 24 hours, 48 hours, 72 hours, 96 hours and 120 hours for subcutaneous delivery. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The average total flux (photons/second) for intramuscular administration is shown in Table 140 and the average total flux (photons/second) for subcutaneous administration is shown in Table 141. The background signal was 3.79E+05 (p/s). The peak expression for intramuscular administration was seen between 24 and 48 hours for all chemistry and expression was still detected at 144 hours. For subcutaneous delivery the peak expression was seen at 2-8 hours and expression was detected at 72 hours.

TABLE 140

Intramuscular Administration

| | 5mC/pU Flux (p/s) | 5mC/N1mpU Flux (p/s) | 5mC/s2U Flux (p/s) | pU Flux (p/s) | N1mpU Flux (p/s) |
| --- | --- | --- | --- | --- | --- |
| 2 hours | 1.98E+07 | 4.65E+06 | 4.68E+06 | 2.33E+06 | 3.66E+07 |
| 8 hours | 1.42E+07 | 3.64E+06 | 3.78E+06 | 8.07E+06 | 7.21E+07 |
| 24 hours | 2.92E+07 | 1.22E+07 | 3.35E+07 | 1.01E+07 | 1.75E+08 |
| 48 hours | 2.64E+07 | 1.01E+07 | 5.06E+07 | 7.46E+06 | 3.42E+08 |
| 72 hours | 2.18E+07 | 8.59E+06 | 3.42E+07 | 4.08E+06 | 5.83E+07 |
| 96 hours | 2.75E+07 | 2.70E+06 | 2.38E+07 | 4.35E+06 | 7.15E+07 |
| 120 hours | 2.19E+07 | 1.60E+06 | 1.54E+07 | 1.25E+06 | 3.87E+07 |
| 144 hours | 9.17E+06 | 2.19E+06 | 1.14E+07 | 1.86E+06 | 5.04E+07 |

TABLE 141

Subcutaneous Administration

| | 5mC/pU Flux (p/s) | 5mC/N1mpU Flux (p/s) | 5mC/s2U Flux (p/s) | pU Flux (p/s) | N1mpU Flux (p/s) |
| --- | --- | --- | --- | --- | --- |
| 2 hours | 5.26E+06 | 4.54E+06 | 9.34E+06 | 2.43E+06 | 2.80E+07 |
| 8 hours | 2.32E+06 | 8.75E+05 | 8.15E+06 | 2.12E+06 | 3.09E+07 |
| 24 hours | 2.67E+06 | 5.49E+06 | 3.80E+06 | 2.24E+06 | 1.48E+07 |
| 48 hours | 1.22E+06 | 1.77E+06 | 3.07E+06 | 1.58E+06 | 1.24E+07 |
| 72 hours | 1.12E+06 | 8.00E+05 | 8.53E+06 | 4.80E+05 | 2.29E+06 |
| 96 hours | 5.16E+05 | 5.33E+05 | 4.30E+05 | 4.30E+05 | 6.62E+05 |
| 120 hours | 3.80E+05 | 4.09E+05 | 3.21E+05 | 6.82E+05 | 5.05E+05 |

Example 92

Osmotic Pump Study

Prior to implantation, an osmotic pump (ALZET® Osmotic Pump 2001D, DURECT Corp. Cupertino, Calif.) is loaded with the 0.2 ml of 1×PBS (pH 7.4) (PBS loaded pump) or 0.2 ml of luciferase modified mRNA (mRNA sequence shown in SEQ ID NO: 33907; polyA tail of approximately 140 nucleotides not shown in sequence; 5'cap, Cap1; fully modified with 5-methylcytosine and N1-methylpseudouridine) at 1 mg/ml in 1×PBS (pH 7.4) (Luciferase loaded pump) and incubated overnight in 1×PBS (pH 7.4) at 37° C.

Balb-C mice (n=3) are implanted subcutaneously with either the PBS loaded pump or the luciferase loaded pump and imaged at 2 hours, 8 hours and 24 hours. As a control a PBS loaded pump is implanted subcutaneously and the mice are injected subcutaneously with luciferase modified mRNA in 1×PBS (PBS loaded pump; SC Luciferase) or an osmotic pump is not implanted and the mice are injected subcutaneously with luciferase modified mRNA in 1×PBS (SC Luciferase). The luciferase formulations are outlined in Table 142.

TABLE 142

Luciferase Formulations

| Group | Vehicle | Conc (mg/ml) | Inj. Vol. (ul) | Amt (ug) | Dose (mg/kg) |
|---|---|---|---|---|---|
| PBS loaded pump; SC Luciferase | PBS | 1.00 | 50 | 50 | 2.5 |
| Luciferase loaded pump | PBS | 1.00 | — | 200 | 10.0 |
| PBS loaded pump | PBS | — | — | — | — |
| SC Luciferase | PBS | 1.00 | 50 | 50 | 2.5 |

Example 93

External Osmotic Pump Study

An external osmotic pump (ALZET® Osmotic Pump 2001D, DURECT Corp. Cupertino, Calif.) is loaded with the 0.2 ml of 1×PBS (pH 7.4) (PBS loaded pump) or 0.2 ml of luciferase modified mRNA (mRNA sequence shown in SEQ ID NO: 33907; polyA tail of approximately 140 nucleotides not shown in sequence; 5'cap, Cap1; fully modified with 5-methylcytosine and N1-methylpseudouridine) at 1 mg/ml in 1×PBS (pH 7.4) (luciferase loaded pump) and incubated overnight in 1×PBS (pH 7.4) at 37° C.

Using a catheter connected to the external PBS loaded pump or the luciferase loaded pump Balb-C mice (n=3) are administered the formulation. The mice are imaged at 2 hours, 8 hours and 24 hours. As a control an external PBS loaded pump is used and the mice are injected subcutaneously with luciferase modified mRNA in 1×PBS (PBS loaded pump; SC Luciferase) or the external pump is not used and the mice are only injected subcutaneously with luciferase modified mRNA in 1×PBS (SC Luciferase). Twenty minutes prior to imaging, mice are injected intraperitoneally with a D-luciferin solution at 150 mg/kg. Animals are then anesthetized and images are acquired with an IVIS Lumina II imaging system (Perkin Elmer). Bioluminescence is measured as total flux (photons/second) of the entire mouse. The luciferase formulations are outlined in Table 143 and the average total flux (photons/second).

TABLE 143

Luciferase Formulations

| Group | Vehicle | Conc (mg/ml) | Inj. Vol. (ul) | Amt (ug) | Dose (mg/kg) |
|---|---|---|---|---|---|
| PBS loaded pump; SC Luciferase | PBS | 1.00 | 50 | 50 | 2.5 |
| Luciferase loaded pump | PBS | 1.00 | — | 200 | 10.0 |

TABLE 143-continued

Luciferase Formulations

| Group | Vehicle | Conc (mg/ml) | Inj. Vol. (ul) | Amt (ug) | Dose (mg/kg) |
|---|---|---|---|---|---|
| PBS loaded pump | PBS | — | — | — | — |
| SC Luciferase | PBS | 1.00 | 50 | 50 | 2.5 |

Example 94

Fibrin Sealant Study

Fibrin sealant, such as Tisseel (Baxter Healthcare Corp., Deerfield, Ill.), is composed of fibrinogen and thrombin in a dual-barreled syringe. Upon mixing, fibrinogen is converted to fibrin to form a fibrin clot in about 10 to 30 seconds. This clot can mimic the natural clotting mechanism of the body. Additionally a fibrin hydrogel is a three dimensional structure that can potentially be used in sustained release delivery. Currently, fibrin sealant is approved for application in hemostasis and sealing to replace conventional surgical techniques such as suture, ligature and cautery.

The thrombin and fibrinogen components were loaded separately into a dual barreled syringe. Balb-C mice (n=3) were injected subcutaneously with 50 ul of fibrinogen, 50 ul of thrombin and they were also injected at the same site with modified luciferase mRNA (mRNA sequence shown in SEQ ID NO: 33907; polyA tail of approximately 140 nucleotides not shown in sequence; 5'cap, Cap1; fully modified with 5-methylcytosine and N1-methylpseudouridine) (Tisseel+Luciferase), 50 ul of fibrinogen and 50 ul thrombin (Tisseel) or modified luciferase mRNA (Luciferase). The injection of fibrinogen and thrombin was done simultaneously using the dual-barreled syringe. The SC injection of luciferase was done 15 minutes after the fibrinogen/thrombin injection to allow the fibrin hydrogel to polymerize (Tisseel+Luciferase group). A control group of untreated mice were also evaluated. The mice were imaged at 5 hours and 24 hours. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The luciferase formulations are outlined in Table 144 and the average total flux (photons/second) is shown in Table 145. The fibrin sealant was found to not interfere with imaging and the injection of luciferase and Tisseel showed expression of luciferase.

TABLE 144

Luciferase Formulations

| Group | Vehicle | Conc (mg/ml) | Inj. Vol. (ul) | Amt (ug) | Dose (mg/kg) |
|---|---|---|---|---|---|
| Tisseel + Luciferase | PBS | 1.00 | 50 | 50 | 2.5 |
| Tisseel | — | — | — | — | — |
| Luciferase | PBS | 1.00 | 50 | 50 | 2.5 |
| Untreated | — | — | — | — | — |

TABLE 145

| Group | 5 Hours Flux (p/s) | 24 Hours Flux (p/s) |
| --- | --- | --- |
| Tisseel + Luciferase | 4.59E+05 | 3.39E+05 |
| Tisseel | 1.99E+06 | 1.06E+06 |
| Luciferase | 9.94E+05 | 7.44E+05 |
| Untreated | 3.90E+05 | 3.79E+05 |

Example 95

Fibrin Containing mRNA Sealant Study

A. Modified mRNA and Calcium Chloride

Prior to reconstitution, luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine or fully modified with N1-methylpseudouridine is added to calcium chloride. The calcium chloride is then used to reconstitute thrombin. Fibrinogen is reconstituted with fibrinolysis inhibitor solution per the manufacturer's instructions. The reconstituted thrombin containing modified mRNA and fibrinogen is loaded into a dual barreled syringe. Mice are injected subcutaneously with 50 ul of fibrinogen and 50 ul of thrombin containing modified mRNA or they were injected with 50 ul of PBS containing an equivalent dose of modified luciferase mRNA. A control group of untreated mice is also evaluated. The mice are imaged at predetermined intervals to determine the average total flux (photons/second).

B. Lipid Nanoparticle Formulated Modified mRNA and Calcium Chloride

Prior to reconstitution, luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine or fully modified with N1-methylpseudouridine is formulated in a lipid nanoparticle is added to calcium chloride. The calcium chloride is then used to reconstitute thrombin. Fibrinogen is reconstituted with fibrinolysis inhibitor solution per the manufacturer's instructions. The reconstituted thrombin containing modified mRNA and fibrinogen is loaded into a dual barreled syringe. Mice are injected subcutaneously with 50 ul of fibrinogen and 50 ul of thrombin containing modified mRNA or they were injected with 50 ul of PBS containing an equivalent dose of modified luciferase mRNA. A control group of untreated mice is also evaluated. The mice are imaged at predetermined intervals to determine the average total flux (photons/second).

C. Modified mRNA and Fibrinogen

Prior to reconstitution, luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine or fully modified with N1-methylpseudouridine is added to the fibrinolysis inhibitor solution. The fibrinolysis inhibitor solution is then used to reconstitute fibrinogen. Thrombin is reconstituted with the calcium chloride solution per the manufacturer's instructions. The reconstituted fibrinogen containing modified mRNA and thrombin is loaded into a dual barreled syringe. Mice are injected subcutaneously with 50 ul of thrombin and 50 ul of fibrinogen containing modified mRNA or they were injected with 50 ul of PBS containing an equivalent dose of modified luciferase mRNA. A control group of untreated mice is also evaluated. The mice are imaged at predetermined intervals to determine the average total flux (photons/second).

D. Lipid Nanoparticle Formulated Modified mRNA and Fibrinogen

Prior to reconstitution, luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine or fully modified with N1-methylpseudouridine is formulated in a lipid nanoparticle is added to the fibrinolysis inhibitor solution. The fibrinolysis inhibitor solution is then used to reconstitute fibrinogen. Thrombin is reconstituted with the calcium chloride solution per the manufacturer's instructions. The reconstituted fibrinogen containing modified mRNA and thrombin is loaded into a dual barreled syringe. Mice are injected subcutaneously with 50 ul of thrombin and 50 ul of fibrinogen containing modified mRNA or they were injected with 50 ul of PBS containing an equivalent dose of modified luciferase mRNA. A control group of untreated mice is also evaluated. The mice are imaged at predetermined intervals to determine the average total flux (photons/second).

E. Modified mRNA and Thrombin

Prior to reconstitution, luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine or fully modified with N1-methylpseudouridine is added to the reconstituted thrombin after it is reconstituted with the calcium chloride per the manufacturer's instructions. The fibrinolysis inhibitor solution is then used to reconstitute fibrinogen per the manufacturer's instructions. The reconstituted fibrinogen and thrombin containing modified mRNA is loaded into a dual barreled syringe. Mice are injected subcutaneously with 50 ul of thrombin containing modified mRNA and 50 ul of fibrinogen or they were injected with 50 ul of PBS containing an equivalent dose of modified luciferase mRNA. A control group of untreated mice is also evaluated. The mice are imaged at predetermined intervals to determine the average total flux (photons/second).

F. Lipid Nanoparticle Formulated Modified mRNA and Thrombin

Prior to reconstitution, luciferase mRNA (mRNA sequence shown in SEQ ID NO: 33907; polyA tail of approximately 140 nucleotides not shown in sequence; 5'cap, Cap1) fully modified with 5-methylcytosine and N1-methylp-seudouridine or fully modified with N1-methyl-pseudouridine is formulated in a lipid nanoparticle is added to the reconstituted thrombin after it is reconstituted with the calcium chloride per the manufactuer's instructions. The fibrinolysis inhibitor solution is then used to reconstitute fibrinogen per the manufacturer's instructions. The reconstituted fibrinogen and thrombin containing modified mRNA is loaded into a dual barreled syringe. Mice are injected subcutaneously with 50 ul of thrombin containing modified mRNA and 50 ul of fibrinogen or they were injected with 50 ul of PBS containing an equivalent dose of modified luciferase mRNA. A control group of untreated mice is also evaluated. The mice are imaged at predetermined intervals to determine the average total flux (photons/second).

Example 96

Cationic Lipid Formulation of 5-Methylcytosine and N1-Methyl-Pseudouridine Modified mRNA Luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine was formulated in the cationic lipids described in Table 146. The formulations were administered intravenously (I.V.), intramuscularly (I.M.) or subcutaneously (S.C.) to Balb-C mice at a dose of 0.05 mg/kg.

TABLE 146

Cationic Lipid Formulations

| Formulation | NPA-126-1 | NPA-127-1 | NPA-128-1 | NPA-129-1 | 111612-B |
|---|---|---|---|---|---|
| Lipid | DLin-MC3-DMA | DLin-KC2-DMA | C12-200 | DLinDMA | DODMA |
| Lipid/mRNA ratio (wt/wt) | 20:1 | 20:1 | 20:1 | 20:1 | 20:1 |
| Mean Size | 122 nm PDI: 0.13 | 114 nm PDI: 0.10 | 153 nm PDI: 0.17 | 137 nm PDI: 0.09 | 223.2 nm PDI: 0.142 |
| Zeta at pH 7.4 | −1.4 mV | −0.5 mV | −1.4 mV | 2.0 mV | −3.09 mV |
| Encaps. (RiboGr) | 95% | 77% | 69% | 80% | 64% |

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours and 24 hours after dosing and the average total flux (photons/second) was measured for each route of administration and cationic lipid formulation. The background flux was about 4.17E+05 p/s. The results of the imaging are shown in Table 147. In Table 147, "NT" means not tested.

TABLE 147

| | | Flux | | | | |
|---|---|---|---|---|---|---|
| Route | Time Point | DLin-MC3-DMA Flux (p/s) | DLin-KC2-DMA Flux (p/s) | C12-200 Flux (p/s) | DLinDMA Flux (p/s) | DODMA Flux (p/s) |
| I.V. | 2 hrs | 1.92E+08 | 2.91E+08 | 1.08E+08 | 2.53E+07 | 8.40E+06 |
| I.V. | 8 hrs | 1.47E+08 | 2.13E+08 | 3.72E+07 | 3.82E+07 | 5.62E+06 |
| I.V. | 24 hrs | 1.32E+07 | 2.41E+07 | 5.35E+06 | 4.20E+06 | 8.97E+05 |
| I.M. | 2 hrs | 8.29E+06 | 2.37E+07 | 1.80E+07 | 1.51E+06 | NT |
| I.M. | 8 hrs | 5.83E+07 | 2.12E+08 | 2.60E+07 | 1.99E+07 | NT |
| I.M. | 24 hrs | 4.30E+06 | 2.64E+07 | 3.01E+06 | 9.46E+05 | NT |
| S.C. | 2 hrs | 1.90E+07 | 5.16E+07 | 8.91E+07 | 4.66E+06 | 9.61E+06 |
| S.C. | 8 hrs | 7.74E+07 | 2.00E+08 | 4.58E+07 | 9.67E+07 | 1.90E+07 |
| S.C. | 24 hrs | 7.49E+07 | 2.47E+07 | 6.96E+06 | 6.50E+06 | 1.28E+06 |

Example 97

Lipid Nanoparticle Intravenous Study

Luciferase mRNA (mRNA sequence shown in SEQ ID NO: 33907; polyA tail of approximately 160 nucleotides not shown in sequence; 5'cap, Cap1; fully modified with 5-methylcytosine and pseudouridine) was formulated in a lipid nanoparticle containing 50% DLin-MC3-DMA OR DLin-KC2-DMA as described in Table 148, 38.5% cholesterol, 10% DSPC and 1.5% PEG. The formulation was administered intravenously (I.V.) to Balb-C mice at a dose of 0.5 mg/kg, 0.05 mg/kg, 0.005 mg/kg or 0.0005 mg/kg. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse.

TABLE 148

| | Formulations | |
|---|---|---|
| Formulation | NPA-098-1 | NPA-100-1 |
| Lipid | DLin-KC2-DMA | DLin-MC3-DMA |
| Lipid/mRNA ratio (wt/wt) | 20:1 | 20:1 |
| Mean Size | 135 nm PDI: 0.08 | 152 nm PDI: 0.08 |
| Zeta at pH 7.4 | −0.6 mV | −1.2 mV |
| Encaps. (RiboGr) | 91% | 94% |

For DLin-KC2-DMA the mice were imaged at 2 hours, 8 hours, 24 hours, 72 hours, 96 hours and 168 hours after dosing and the average total flux (photons/second) was measured for each route of administration and cationic lipid formulation. The background flux was about 3.66E+05 p/s. The results of the imaging are shown in Table 149. Organs were imaged at 8 hours and the average total flux (photons/second) was measured for the liver, spleen, lung and kidney. A control for each organ was also analyzed. The results are shown in Table 150. The peak signal for all dose levels was at 8 hours after administration. Also, distribution to the various organs (liver, spleen, lung, and kidney) may be able to be controlled by increasing or decreasing the LNP dose.

TABLE 149

| | Flux | | | |
|---|---|---|---|---|
| Time Point | 0.5 mg/kg Flux (p/s) | 0.05 mg/kg Flux (p/s) | 0.005 mg/kg Flux (p/s) | 0.0005 mg/kg Flux (p/s) |
| 2 hrs | 3.54E+08 | 1.75E+07 | 2.30E+06 | 4.09E+05 |
| 8 hrs | 1.67E+09 | 1.71E+08 | 9.81E+06 | 7.84E+05 |

TABLE 149-continued

| | Flux | | | |
|---|---|---|---|---|
| Time Point | 0.5 mg/kg Flux (p/s) | 0.05 mg/kg Flux (p/s) | 0.005 mg/kg Flux (p/s) | 0.0005 mg/kg Flux (p/s) |
| 24 hrs | 2.05E+08 | 2.67E+07 | 2.49E+06 | 5.51E+05 |
| 72 hrs | 8.17E+07 | 1.43E+07 | 1.01E+06 | 3.75E+05 |
| 96 hrs | 4.10E+07 | 9.15E+06 | 9.58E+05 | 4.29E+05 |
| 168 hrs | 3.42E+07 | 9.15E+06 | 1.47E+06 | 5.29E+05 |

TABLE 150

| | Organ Flux | | | |
|---|---|---|---|---|
| | Liver Flux (p/s) | Spleen Flux (p/s) | Lung Flux (p/s) | Kidney Flux (p/s) |
| 0.5 mg/kg | 1.42E+08 | 4.86E+07 | 1.90E+05 | 3.20E+05 |
| 0.05 mg/kg | 7.45E+06 | 4.62E+05 | 6.86E+04 | 9.11E+04 |
| 0.005 mg/kg | 3.32E+05 | 2.97E+04 | 1.42E+04 | 1.15E+04 |
| 0.0005 mg/kg | 2.34E+04 | 1.08E+04 | 1.87E+04 | 9.78E+03 |
| Untreated | 1.88E+04 | 1.02E+04 | 1.41E+04 | 9.20E+03 |

For DLin-MC3-DMA the mice were imaged at 2 hours, 8 hours, 24 hours, 48 hours, 72 hours and 144 hours after dosing and the average total flux (photons/second) was measured for each route of administration and cationic lipid formulation. The background flux was about 4.51E+05 p/s. The results of the imaging are shown in Table 151. Organs were imaged at 8 hours and the average total flux (photons/second) was measured for the liver, spleen, lung and kidney. A control for each organ was also analyzed. The results are shown in Table 152. The peak signal for all dose levels was at 8 hours after administration. Also, distribution to the various organs (liver, spleen, lung, and kidney) may be able to be controlled by increasing or decreasing the LNP dose.

TABLE 151

| | Flux | | | |
|---|---|---|---|---|
| Time Point | 0.5 mg/kg Flux (p/s) | 0.05 mg/kg Flux (p/s) | 0.005 mg/kg Flux (p/s) | 0.0005 mg/kg Flux (p/s) |
| 2 hrs | 1.23E+08 | 7.76E+06 | 7.66E+05 | 4.88E+05 |
| 8 hrs | 1.05E+09 | 6.79E+07 | 2.75E+06 | 5.61E+05 |
| 24 hrs | 4.44E+07 | 1.00E+07 | 1.06E+06 | 5.71E+05 |
| 48 hrs | 2.12E+07 | 4.27E+06 | 7.42E+05 | 4.84E+05 |
| 72 hrs | 1.34E+07 | 5.84E+06 | 6.90E+05 | 4.38E+05 |
| 144 hrs | 4.26E+06 | 2.25E+06 | 4.58E+05 | 3.99E+05 |

TABLE 152

| | Organ Flux | | | |
|---|---|---|---|---|
| | Liver Flux (p/s) | Spleen Flux (p/s) | Lung Flux (p/s) | Kidney Flux (p/s) |
| 0.5 mg/kg | 1.19E+08 | 9.66E+07 | 1.19E+06 | 1.85E+05 |
| 0.05 mg/kg | 1.10E+07 | 1.79E+06 | 7.23E+04 | 5.82E+04 |
| 0.005 mg/kg | 3.58E+05 | 6.04E+04 | 1.33E+04 | 1.33E+04 |
| 0.0005 mg/kg | 2.25E+04 | 1.88E+04 | 2.05E+04 | 1.65E+04 |
| Untreated | 1.91E+04 | 1.66E+04 | 2.63E+04 | 2.14E+04 |

Example 98

Lipid Nanoparticle Subcutaneous Study

Luciferase mRNA (mRNA sequence shown in SEQ ID NO: 33907; polyA tail of approximately 160 nucleotides not shown in sequence; 5'cap, Cap1; fully modified with 5-methylcytosine and pseudouridine) was formulated in a lipid nanoparticle containing 50% DLin-KC2-DMA as described in Table 153, 385% cholesterol, 10% DSPC and 1.5% PEG. The formulation was administered subcutaneously (S.C.) to Balb-C mice at a dose of 0.5 mg/kg, 0.05 mg/kg or 0.005 mg/kg.

TABLE 153

| DLin-KC2-DMA Formulation | |
|---|---|
| Formulation | NPA-098-1 |
| Lipid | DLin-KC2-DMA |
| Lipid/mRNA ratio (wt/wt) | 20:1 |
| Mean Size | 135 nm |
| | PDI: 0.08 |
| Zeta at pH 7.4 | −0.6 mV |
| Encaps. (RiboGr) | 91% |

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours, 24 hours, 48 hours, 72 hours and 144 hours after dosing and the average total flux (photons/second) was measured for each route of administration and cationic lipid formulation. The lower limit of detection was about 3E+05 p/s. The results of the imaging are shown in Table 154. Organs were imaged at 8 hours and the average total flux (photons/second) was measured for the liver, spleen, lung and kidney. A control for each organ was also analyzed. The results are shown in Table 155. The peak signal for all dose levels was at 8 hours after administration. Also, distribution to the various organs (liver, spleen, lung, and kidney) may be able to be controlled by increasing or decreasing the LNP dose. At high doses, the LNP formulations migrates outside of the subcutaneous injection site, as high levels of luciferase expression are detected in the liver, spleen, lung, and kidney.

TABLE 154

| | Flux | | |
|---|---|---|---|
| Time Point | 0.5 mg/kg Flux (p/s) | 0.05 mg/kg Flux (p/s) | 0.005 mg/kg Flux (p/s) |
| 2 hrs | 3.18E+07 | 7.46E+06 | 8.94E+05 |
| 8 hrs | 5.15E+08 | 2.18E+08 | 1.34E+07 |
| 24 hrs | 1.56E+08 | 5.30E+07 | 7.16E+06 |
| 48 hrs | 5.22E+07 | 8.75E+06 | 9.06E+05 |
| 72 hrs | 8.87E+06 | 1.50E+06 | 2.98E+05 |
| 144 hrs | 4.55E+05 | 3.51E+05 | 2.87E+05 |

TABLE 155

| | Organ Flux | | | |
|---|---|---|---|---|
| | Liver Flux (p/s) | Spleen Flux (p/s) | Lung Flux (p/s) | Kidney Flux (p/s) |
| 0.5 mg/kg | 1.01E+07 | 7.43E+05 | 9.75E+04 | 1.75E+05 |
| 0.05 mg/kg | 1.61E+05 | 3.94E+04 | 4.04E+04 | 3.29E+04 |
| 0.005 mg/kg | 2.84E+04 | 2.94E+04 | 2.42E+04 | 9.79E+04 |
| Untreated | 1.88E+04 | 1.02E+04 | 1.41E+04 | 9.20E+03 |

Example 99

Cationic Lipid Nanoparticle Subcutaneous Study

Luciferase mRNA (mRNA sequence shown in SEQ ID NO: 33907; polyA tail of approximately 160 nucleotides not shown in sequence; 5'cap, Cap1; fully modified with 5-methylcytosine and pseudouridine) is formulated in a lipid nanoparticle containing 50% DLin-MC3-DMA, 38.5% cholesterol, 10% DSPC and 1.5% PEG. The formulation is administered subcutaneously (S.C.) to Balb-C mice at a dose of 0.5 mg/kg, 0.05 mg/kg or 0.005 mg/kg.

The mice are imaged at 2 hours, 8 hours, 24 hours, 48 hours, 72 hours and 144 hours after dosing and the average total flux (photons/second) was measured for each route of administration and cationic lipid formulation. Organs are imaged at 8 hours and the average total flux (photons/second) is measured for the liver, spleen, lung and kidney. A control for each organ is also analyzed.

Example 100

Luciferase Lipoplex Study

Lipoplexed luciferase mRNA (mRNA sequence shown in SEQ ID NO: 33907; polyA tail of approximately 140 nucleotides not shown in sequence; 5'cap, Cap1) fully modified with 5-methylcytosine and pseudouridine (5mC/pU), fully modified with 5-methylcytosine and N1-methyl-pseudouridine (5mC/N1mpU) or modified where 25% of the cytosines replaced with 5-methylcytosine and 25% of the uridines replaced with 2-thiouridine (5mC/s2U). The formulation was administered intravenously (I.V.), intramuscularly (I.M.) or subcutaneously (S.C.) to Balb-C mice at a dose of 0.10 mg/kg.

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 8 hours, 24 hours and 48 hours after dosing and the average total flux (photons/second) was measured for each route of administration and chemical modification. The background signal was about 3.91E+05 p/s. The results of the imaging are shown in Table 156. Organs were imaged at 6 hours and the average total flux (photons/second) was measured for the liver, spleen, lung and kidney. A control for each organ was also analyzed. The results are shown in Table 157.

TABLE 156

| | | Flux | | |
|---|---|---|---|---|
| Route | Time Point | 5mC/pU Flux (p/s) | 5mC/N1mpU Flux (p/s) | 5mC/s2U Flux (p/s) |
| I.V. | 8 hrs | 5.76E+06 | 1.78E+06 | 1.88E+06 |
| I.V. | 24 hrs | 1.02E+06 | 7.13E+05 | 5.28E+05 |
| I.V. | 48 hrs | 4.53E+05 | 3.76E+05 | 4.14E+05 |
| I.M. | 8 hrs | 1.90E+06 | 2.53E+06 | 1.29E+06 |
| I.M. | 24 hrs | 9.33E+05 | 7.84E+05 | 6.48E+05 |
| I.M. | 48 hrs | 8.51E+05 | 6.59E+05 | 5.49E+05 |
| S.C. | 8 hrs | 2.85E+06 | 6.48E+06 | 1.14E+06 |
| S.C. | 24 hrs | 6.66E+05 | 7.15E+06 | 3.93E+05 |
| S.C. | 48 hrs | 3.24E+05 | 3.20E+06 | 5.45E+05 |

TABLE 157

| | | Organ Flux | | | | |
|---|---|---|---|---|---|---|
| Route | Chemistry | Liver Flux (p/s) | Spleen Flux (p/s) | Lung Flux (p/s) | Kidney Flux (p/s) | Inj. Site Flux (p/s) |
| I.V. | 5mC/pU | 5.26E+05 | 2.04E+07 | 4.28E+06 | 1.77E+04 | n/a |
| I.V. | 5mC/N1mpU | 1.48E+05 | 5.00E+06 | 1.93E+06 | 1.77E+04 | n/a |
| I.V. | 5mC/s2U | 2.14E+04 | 3.29E+06 | 5.48E+05 | 2.16E+04 | n/a |
| I.M. | 5mC/pU | 2.46E+04 | 1.38E+04 | 1.50E+04 | 1.44E+04 | 1.15E+06 |
| I.M. | 5mC/N1mpU | 1.72E+04 | 1.76E+04 | 1.99E+04 | 1.56E+04 | 1.20E+06 |
| I.M. | 5mC/s2U | 1.28E+04 | 1.36E+04 | 1.33E+04 | 1.07E+04 | 7.60E+05 |
| S.C. | 5mC/pU | 1.55E+04 | 1.67E+04 | 1.45E+04 | 1.69E+04 | 4.46E+04 |
| S.C. | 5mC/N1mpU | 1.20E+04 | 1.46E+04 | 1.38E+04 | 1.14E+04 | 8.29E+04 |
| S.C. | 5mC/s2U | 1.22E+04 | 1.31E+04 | 1.45E+04 | 1.08E+04 | 5.62E+04 |
| | Untreated | 2.59E+04 | 1.34E+04 | 1.26E+04 | 1.22E+04 | n/a |

Example 101

Cationic Lipid Formulation of Modified mRNA

Luciferase mRNA (mRNA sequence shown in SEQ ID NO: 33907; polyA tail of approximately 140 nucleotides not shown in sequence; 5'cap, Cap1) modified where 25% of the cytosines replaced with 5-methylcytosine and 25% of the uridines replaced with 2-thiouridine (5mC/s2U) was formulated in the cationic lipids described in Table 158. The formulations were administered intravenously (I.V.), intramuscularly (I.M.) or subcutaneously (S.C.) to Balb-C mice at a dose of 0.05 mg/kg.

TABLE 158

| | Cationic Lipid Formulations | | | | |
|---|---|---|---|---|---|
| Formulation | NPA-130-1 | NPA-131-1 | NPA-132-1 | NPA-133-1 | 111612-C |
| Lipid | DLin-MC3-DMA | DLin-KC2-DMA | C12-200 | DLinDMA | DODMA |
| Lipid/mRNA ratio (wt/wt) | 20:1 | 20:1 | 20:1 | 20:1 | 20:1 |

TABLE 158-continued

Cationic Lipid Formulations

| Formulation | NPA-130-1 | NPA-131-1 | NPA-132-1 | NPA-133-1 | 111612-C |
|---|---|---|---|---|---|
| Mean Size | 120 nm<br>PDI: 0.10 | 105 nm<br>PDI: 0.11 | 122 nm<br>PDI: 0.13 | 105 nm<br>PDI: 0.14 | 221.3 nm<br>PDI: 0.063 |
| Zeta at pH 7.4 | 0.2 mV | −0.6 mV | −0.5 mV | −0.3 mV | −3.10 mV |
| Encaps. (RiboGr) | 100% | 100% | 93% | 93% | 60% |

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours and 24 hours after dosing and the average total flux (photons/second) was measured for each route of administration and cationic lipid formulation. The background flux was about 3.31E+05 p/s. The results of the imaging are shown in Table 159. In Table 159, "NT" means not tested. Untreated mice showed an average flux of 3.14E+05 at 2 hours, 3.33E+05 at 8 hours and 3.46E+05 at 24 hours. Peak expression was seen for all three routes tested at 8 hours. DLin-KC2-DMA has better expression than DLin-MC3-DMA and DODMA showed expression for all routes evaluated.

TABLE 159

Flux

| Route | Time Point | DLin-MC3-DMA Flux (p/s) | DLin-KC2-DMA Flux (p/s) | C12-200 Flux (p/s) | DLinDMA Flux (p/s) | DODMA Flux (p/s) |
|---|---|---|---|---|---|---|
| I.V. | 2 hrs | 9.88E+06 | 6.98E+07 | 9.18E+06 | 3.98E+06 | 5.79E+06 |
| I.V. | 8 hrs | 1.21E+07 | 1.23E+08 | 1.02E+07 | 5.98E+06 | 6.14E+06 |
| I.V. | 24 hrs | 2.02E+06 | 1.05E+07 | 1.25E+06 | 1.35E+06 | 5.72E+05 |
| I.M. | 2 hrs | 6.72E+05 | 3.66E+06 | 3.25E+06 | 7.34E+05 | 4.42E+05 |
| I.M. | 8 hrs | 7.78E+06 | 2.85E+07 | 4.29E+06 | 2.22E+06 | 1.38E+06 |
| I.M. | 24 hrs | 4.22E+05 | 8.79E+05 | 5.95E+05 | 8.48E+05 | 4.80E+05 |
| S.C. | 2 hrs | 2.37E+06 | 4.77E+06 | 4.44E+06 | 1.07E+06 | 1.05E+06 |
| S.C. | 8 hrs | 3.65E+07 | 1.17E+08 | 3.71E+06 | 9.33E+06 | 2.57E+06 |
| S.C. | 24 hrs | 4.47E+06 | 1.28E+07 | 6.39E+05 | 8.89E+05 | 4.27E+05 |

Example 102

Formulation of 5-Methylcytosine and N1-Methyl-Pseudouridine Modified mRNA

Luciferase mRNA (mRNA sequence shown in SEQ ID NO: 33907; polyA tail of approximately 140 nucleotides not shown in sequence; 5'cap, Cap1) fully modified with 5-methylcytosine and N1-methyl-pseudouridine was formulated in PBS (pH of 7.4). The formulations were administered intramuscularly (I.M.) or subcutaneously (S.C.) to Balb-C mice at a dose of 2.5 mg/kg.

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 5 minutes, 30 minutes, 60 minutes and 120 minutes after dosing and the average total flux (photons/second) was measured for each route of administration and cationic lipid formulation. The background flux was about 3.78E+05 p/s. The results of the imaging are shown in Table 160. Expression of luciferase was already seen at 30 minutes with both routes of delivery. Peak expression from subcutaneous administration appears between 30 to 60 minutes. Intramuscular expression was still increasing at 120 minutes.

TABLE 160

Flux

| Route | Time Point | PBS (pH 7.4) Flux (p/s) |
|---|---|---|
| I.M. | 5 min | 4.38E+05 |
| I.M. | 30 min | 1.09E+06 |
| I.M. | 60 min | 1.18E+06 |
| I.M. | 120 min | 2.86E+06 |
| S.C. | 5 min | 4.19E+05 |
| S.C. | 30 min | 6.38E+06 |
| S.C. | 60 min | 5.61E+06 |
| S.C. | 120 min | 2.66E+06 |

Example 103

Intramuscular and Subcutaneous Administration of Chemically Modified mRNA

Luciferase modified mRNA (mRNA sequence shown in SEQ ID NO: 33907; polyA tail of approximately 140 nucleotides not shown in sequence; 5'cap, Cap1) fully modified with N4-acetylcytidine, fully modified with 5-methoxyuridine, fully modified with N4-acetylcytidine and N1-methyl-pseudouridine or fully modified 5-methylcytosine and 5-methoxyuridine formulated in PBS (pH 7.4) was administered to Balb-C mice intramuscularly or subcutaneously at a dose of 2.5 mg/kg. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours and 24 hours. The average total flux (photons/second) for intramuscular administration is shown in Table 161 and the average total flux (photons/second) for subcutaneous administration is shown in Table 162. The background signal was 3.84E+05 (p/s). The peak expression for intramuscular administration was seen between 24 and 48 hours for all chemistry and expression was still detected at 120 hours. For subcutaneous delivery the peak expression was seen at 2-8 hours and expression was detected at 72 hours.

TABLE 161

Intramuscular Administration

| | 2 hours Flux (p/s) | 8 hours Flux (p/s) | 24 hours Flux (p/s) |
|---|---|---|---|
| N4-acetylcytidine | 1.32E+07 | 2.15E+07 | 4.01E+07 |
| 5-methoxyuridine | 4.93E+06 | 1.80E+07 | 4.53E+07 |
| N4-acetylcytidine/ N1-methylpseudouridine | 2.02E+07 | 1.93E+07 | 1.63E+08 |
| 5-methylcytosine/5-methoxyuridine | 6.79E+06 | 4.55E+07 | 3.44E+07 |

TABLE 162

Subcutaneous Administration

| | 2 hours Flux (p/s) | 8 hours Flux (p/s) | 24 hours Flux (p/s) |
|---|---|---|---|
| N4-acetylcytidine | 3.07E+07 | 1.23E+07 | 1.28E+07 |
| 5-methoxyuridine | 7.10E+06 | 9.38E+06 | 1.32E+07 |
| N4-acetylcytidine/ N1-methylpseudouridine | 7.12E+06 | 3.07E+06 | 1.03E+07 |
| 5-methylcytosine/5-methoxyuridine | 7.15E+06 | 1.25E+07 | 1.11E+07 |

Example 104

In Vivo Study

Luciferase modified mRNA containing at least one chemical modification is formulated as a lipid nanoparticle (LNP) using the syringe pump method and characterized by particle size, zeta potential, and encapsulation.

As outlined in Table 163, the luciferase LNP formulation is administered to Balb-C mice intramuscularly (I.M.), intravenously (I.V.) and subcutaneously (S.C.). As a control luciferase modified RNA formulated in PBS is administered intravenously to mice.

TABLE 163

Luciferase Formulations

| Formulation | Vehicle | Route | Concentration (mg/ml) | Injection Volume (ul) | Amount of modified RNA (ug) | Dose (mg/kg) |
|---|---|---|---|---|---|---|
| Luc-LNP | PBS | S.C. | 0.2000 | 50 | 10 | 0.5000 |
| Luc-LNP | PBS | S.C. | 0.0200 | 50 | 1 | 0.0500 |
| Luc-LNP | PBS | S.C. | 0.0020 | 50 | 0.1 | 0.0050 |
| Luc-LNP | PBS | S.C. | 0.0002 | 50 | 0.01 | 0.0005 |
| Luc-LNP | PBS | I.V. | 0.2000 | 50 | 10 | 0.5000 |
| Luc-LNP | PBS | I.V. | 0.0200 | 50 | 1 | 0.0500 |
| Luc-LNP | PBS | I.V. | 0.0020 | 50 | 0.1 | 0.0050 |
| Luc-LNP | PBS | I.V. | 0.0002 | 50 | 0.01 | 0.0005 |
| Luc-LNP | PBS | I.M. | 0.2000 | 50 | 10 | 0.5000 |
| Luc-LNP | PBS | I.M. | 0.0200 | 50 | 1 | 0.0500 |
| Luc-LNP | PBS | I.M. | 0.0020 | 50 | 0.1 | 0.0050 |
| Luc-LNP | PBS | I.M. | 0.0002 | 50 | 0.01 | 0.0005 |
| Luc-PBS | PBS | I.V. | 0.20 | 50 | 10 | 0.50 |

The mice are imaged at 2, 8, 24, 48, 120 and 192 hours to determine the bioluminescence (measured as total flux (photons/second) of the entire mouse). At 8 hours or 192 hours the liver, spleen, kidney and injection site for subcutaneous and intramuscular administration are imaged to determine the bioluminescence.

Example 105

Cationic Lipid Formulation Studies of Chemically Modified mRNA

Luciferase mRNA (mRNA sequence shown in SEQ ID NO: 33907; polyA tail of approximately 140 nucleotides not shown in sequence; 5'cap, Cap1) fully modified with 5-methylcytosine and pseudouridine (5mC/pU), pseudouridine (pU) or N1-methyl-pseudouridine (N1mpU) was formulated in the cationic lipids described in Table 164. The formulations were administered intravenously (I.V.), intramuscularly (I.M.) or subcutaneously (S.C.) to Balb-C mice at a dose of 0.05 mg/kg.

TABLE 164

Cationic Lipid Formulations

| Formulation | NPA-137-1 | NPA-134-1 | NPA-135-1 | NPA-136-1 | 111612-A |
|---|---|---|---|---|---|
| Lipid | DLin-MC3-DMA | DLin-MC3-DMA | DLin-KC2-DMA | C12-200 | DODMA |
| Lipid/mRNA ratio (wt/wt) | 20:1 | 20:1 | 20:1 | 20:1 | 20:1 |
| Mean Size | 111 nm PDI: 0.15 | 104 nm PDI: 0.13 | 95 nm PDI: 0.11 | 143 nm PDI: 0.12 | 223.2 nm PDI: 0.142 |
| Zeta at pH 7.4 | −4.1 mV | −1.9 mV | −1.0 mV | 0.2 mV | −3.09 mV |
| Encaps. (RiboGr) | 97% | 100% | 100% | 78% | 64% |
| Chemistry | pU | N1mpU | N1mpU | N1mpU | 5mC/pU |

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours and 24 hours after dosing and the average total flux (photons/second) was measured for each route of administration and cationic lipid formulation. The background flux was about 4.11E+05 p/s. The results of the imaging are shown in Table 165. Peak expression was seen for all three routes tested at 8 hours.

TABLE 165

| | | Flux | | | | |
|---|---|---|---|---|---|---|
| Route | Time Point | DLin-MC3-DMA (pU) Flux (p/s) | DLin-MC3-DMA (N1mpU) Flux (p/s) | DLin-KC2-DMA (N1mpU) Flux (p/s) | C12-200 (N1mpU) Flux (p/s) | DODMA (5mC/pU) Flux (p/s) |
| I.V. | 2 hrs | 3.21E+08 | 1.24E+09 | 1.01E+09 | 9.00E+08 | 3.90E+07 |
| I.V. | 8 hrs | 1.60E+09 | 3.22E+09 | 2.38E+09 | 1.11E+09 | 1.17E+07 |
| I.V. | 24 hrs | 1.41E+08 | 3.68E+08 | 3.93E+08 | 8.06E+07 | 1.11E+07 |
| I.M. | 2 hrs | 2.09E+07 | 3.29E+07 | 8.32E+07 | 9.43E+07 | 4.66E+06 |
| I.M. | 8 hrs | 2.16E+08 | 6.14E+08 | 1.00E+09 | 8.77E+07 | 7.05E+06 |
| I.M. | 24 hrs | 1.23E+07 | 1.40E+08 | 5.09E+08 | 1.36E+07 | 1.14E+06 |
| S.C. | 2 hrs | 2.32E+07 | 3.60E+07 | 2.14E+08 | 1.01E+08 | 3.11E+07 |
| S.C. | 8 hrs | 5.55E+08 | 9.80E+08 | 4.93E+09 | 1.01E+09 | 8.04E+07 |
| S.C. | 24 hrs | 1.81E+08 | 2.74E+08 | 2.12E+09 | 4.74E+07 | 1.34E+07 |

Example 106

Studies of Chemical Modified mRNA

Luciferase mRNA (mRNA sequence shown in SEQ ID NO: 33907; polyA tail of approximately 140 nucleotides not shown in sequence; 5'cap, Cap1) fully modified with N4-acetylcytidine (N4-acetyl), fully modified with 5-methoxyuridine (5-meth), fully modified with N4-acetylcytidine and N1-methyl-pseudouridine (N4-acetyl/N1mpU) or fully modified with 5-methylcytosine and 5-methoxyuridine (5mC/5-meth) was formulated in DLin-MC3-DMA as described in Table 166.

The formulations were administered intravenously (I.V.), intramuscularly (I.M.) or subcutaneously (S.C.) to Balb-C mice at a dose of 0.05 mg/kg.

TABLE 166

| | Cationic Lipid Formulations | | | |
|---|---|---|---|---|
| Formulation | NPA-141-1 | NPA-142-1 | NPA-143-1 | NPA-144-1 |
| Lipid | DLin-MC3-DMA | DLin-MC3-DMA | DLin-MC3-DMA | DLin-MC3-DMA |
| Lipid/mRNA ratio (wt/wt) | 20:1 | 20:1 | 20:1 | 20:1 |
| Mean Size | 138 nm PDI: 0.16 | 116 nm PDI: 0.15 | 144 nm PDI: 0.15 | 131 nm PDI: 0.15 |
| Zeta at pH 7.4 | −2.8 mV | −2.8 mV | −4.3 mV | −5.0 mV |
| Encaps. (RiboGr) | 97% | 100% | 75% | 72% |
| Chemistry | N4-acetyl | 5meth | N4-acetyl/N1mpU | 5mC/5-meth |

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 6 hours and 24 hours after dosing and the average total flux (photons/second) was measured for each route of administration and cationic lipid formulation. The background flux was about 2.70E+05 p/s. The results of the imaging are shown in Table 167.

TABLE 167

| | | Flux | | | |
|---|---|---|---|---|---|
| Route | Time Point | N4-acetyl Flux (p/s) | 5meth Flux (p/s) | N4-acetyl/N1mpU Flux (p/s) | 5mC/5-meth Flux (p/s) |
| I.V. | 2 hrs | 9.17E+07 | 3.19E+06 | 4.21E+07 | 1.88E+06 |
| I.V. | 6 hrs | 7.70E+08 | 9.28E+06 | 2.34E+08 | 7.75E+06 |
| I.V. | 24 hrs | 6.84E+07 | 1.04E+06 | 3.55E+07 | 3.21E+06 |
| I.M. | 2 hrs | 8.59E+06 | 7.86E+05 | 5.30E+06 | 5.11E+05 |
| I.M. | 6 hrs | 1.27E+08 | 8.88E+06 | 3.82E+07 | 3.17E+06 |
| I.M. | 24 hrs | 4.46E+07 | 1.38E+06 | 2.00E+07 | 1.39E+06 |
| S.C. | 2 hrs | 1.83E+07 | 9.67E+05 | 4.45E+06 | 1.01E+06 |
| S.C. | 6 hrs | 2.89E+08 | 1.78E+07 | 8.91E+07 | 1.29E+07 |
| S.C. | 24 hrs | 6.09E+07 | 6.40E+06 | 2.08E+08 | 6.63E+06 |

Example 107

Lipid Nanoparticle Containing a Plurality of Modified mRNAs

EPO mRNA (mRNA sequence shown in SEQ ID NO: 33900; polyA tail of approximately 140 nucleotides not shown in sequence; 5'cap, Cap1; fully modified with 5-methylcytosine and N1-methyl-pseudouridine), G-CSF mRNA (mRNA sequence shown in SEQ ID NO: 33897; polyA tail of approximately 140 nucleotides not shown in sequence; 5'cap, Cap1; fully modified with 5-methylcytosine and N1-methyl-pseudouridine) and Factor IX mRNA (mRNA sequence shown in SEQ ID NO: 33901; polyA tail of approximately 140 nucleotides not shown in sequence; 5'cap, Cap1; fully modified with 5-methylcytosine and N1-methylpseudouridine), is formulated in DLin-MC3-DMA as described in Table 168. The formulations are administered intravenously (I.V.), intramuscularly (I.M.) or subcutaneously (S.C.) to Balb-C mice at a dose of 0.05 mg/kg. Control LNP formulations containing only one mRNA are also administered at an equivalent dose.

TABLE 168

DLin-MC3-DMA Formulation

| | Formulation NPA-157-1 |
|---|---|
| Lipid | DLin-MC3-DMA |
| Lipid/mRNA ratio (wt/wt) | 20:1 |
| Mean Size | 89 nm PDI: 0.08 |
| Zeta at pH 7.4 | 1.1 mV |
| Encaps. (RiboGr) | 97% |

Serum is collected from the mice at 8 hours, 24 hours, 72 hours and/or 7 days after administration of the formulation. The serum is analyzed by ELISA to determine the protein expression of EPO, G-CSF, and Factor IX.

Example 108

Cationic Lipid Formulation Studies of 5-Methylcytosine and N1-Methyl-pseudouridine Modified mRNA EPO mRNA (mRNA sequence shown in SEQ ID NO: 33900; polyA tail of approximately 140 nucleotides not shown in sequence; 5'cap, Cap1; fully modified with 5-methylcytosine and N1-methyl-pseudouridine) or G-CSF mRNA (mRNA sequence shown in SEQ ID NO: 33897; polyA tail of approximately 140 nucleotides not shown in sequence; 5'cap, Cap1; fully modified with 5-methylcytosine and N1-methylpseudouridine) is formulated in DLin-MC3-DMA and DLin-KC2-DMA as described in Table 169. The formulations are administered intravenously (I.V), intramuscularly (I.M.) or subcutaneously (S.C.) to Balb-C mice at a dose of 0.05 mg/kg.

TABLE 169

DLin-MC3-DMA and DLin-KC2-DMA Formulations

| | Formulation | | | |
|---|---|---|---|---|
| | NPA-147-1 | NPA-148-1 | NPA-150-1 | NPA-151-1 |
| mRNA | EPO | EPO | G-CSF | G-CSF |
| Lipid | DLin-MC3-DMA | DLin-KC2-DMA | DLin-MC3-DMA | DLin-KC2-DMA |
| Lipid/mRNA ratio (wt/wt) | 20:1 | 20:1 | 20:1 | 20:1 |
| Mean Size | 117 nm PDI: 0.14 | 82 nm PDI: 0.08 | 119 nm PDI: 0.13 | 88 nm PDI: 0.08 |
| Zeta at pH 7.4 | −1.7 mV | 0.6 mV | 3.6 mV | 2.2 mV |
| Encaps. (RiboGr) | 100% | 96% | 100% | 100% |

Serum is collected from the mice at 8 hours, 24 hours, 72 hours and/or 7 days after administration of the formulation. The serum is analyzed by ELISA to determine the protein expression of EPO and G-CSF.

Example 109

In Vitro VEGF PBMC Study 500 ng of VEGF mRNA (mRNA sequence shown in SEQ ID NO: 33910 polyA tail of approximately 160 nucleotides not shown in sequence; 5'cap, Cap1) fully modified with 5-methylcytosine and pseudouridine (VEGF 5mC/pU), fully modified with 5-methylcytosine and N1-methyl-pseudouridine (VEGF 5mC/N1mpU) or unmodified (VEGF unmod) was transfected with 0.4 uL of Lipofectamine 2000 into peripheral blood mononuclear cells (PBMC) from three normal blood donors (D1, D2, and D3). Cells were also untreated for each donor as a control. The supernatant was harvested and run by ELISA 22 hours after transfection to determine the protein expression and cytokine induction. The expression of VEGF and IFN-alpha induction is shown in Table 170.

TABLE 170

Protein and Cytokine levels

| | VEGF Expression (pg/ml) | | | IFN-alpha Induction (pg/ml) | | |
|---|---|---|---|---|---|---|
| | D1 | D2 | D3 | D1 | D2 | D3 |
| VEGF unmod | 2 | 0 | 0 | 5400 | 3537 | 4946 |
| VEGF 5mC/pU | 424 | 871 | 429 | 145 | 294 | 106 |
| VEGF 5mC/N1mpU | 5088 | 10331 | 6183 | 205 | 165 | 6 |

Example 110

In Vitro Expression of Modified mRNA

HEK293 cells were transfected with VEGF-A modified mRNA (mRNA sequence shown in SEQ ID NO: 33910; polyA tail of approximately 160 nucleotides not shown in sequence; 5'cap, Cap1; fully modified with 5-methylcytosine and pseudouridine) or EPO modified mRNA (mRNA sequence shown in SEQ ID NO: 33900; polyA tail of approximately 160 nucleotides not shown in sequence; 5'cap, Cap1; fully modified with 5-methylcytosine and pseudouridine), HeLa cells were forward transfected with Transforming growth factor beta (TGF-beta) modified mRNA (mRNA sequence shown in SEQ ID NO: 33911; poly A tail of approximately 160 nucleotides not shown in sequence; 5'cap, Cap1; fully modified with 5-methylcytosine and pseudouridine) and HepG2 cells were transfected with bactericidal/permeability-increasing protein (rBPI-21) modified mRNA (mRNA sequence shown in SEQ ID NO: 33912; poly A tail of approximately 160 nucleotides not shown in sequence; 5'cap, Cap1; fully modified with 5-methylcytosine and pseudouridine) which had been complexed with Lipofectamine2000 from Invitrogen (Carlsbad, Calif.) at the concentrations shown in Table 171, 172 and 173 using the procedures described herein. The protein expression was detected by ELISA and the protein (pg/ml) is also shown in Table 171, 172 and 173. In Table 171, ">" means greater than. For TGF-beta a control of untreated cells and a mock transfection of Lipofectamine2000 was also tested.

TABLE 171

EPO Protein Expression

| | Amount Transfected | | | | | | | |
|---|---|---|---|---|---|---|---|---|
| | 5 ng | 1 ng | 200 pg | 40 pg | 8 pg | 1.6 pg | 320 fg | 64 fg |
| Protein (pg/ml) | >2000 | 609.486 | 114.676 | 0 | 0 | 0 | 0 | 0 |

TABLE 172

TGF-beta Protein Expression

| | Amount Transfected | | | | |
|---|---|---|---|---|---|
| | 750 ng | 250 ng | 83 ng | Mock | Untreated |
| Protein (pg/ml) | 5058 | 4325 | 3210 | 2 | 0 |

TABLE 173 rBPI-21 Protein Expression

| | Amount Transfected | | | | | | | |
|---|---|---|---|---|---|---|---|---|
| | 2 ug | 400 ng | 80 ng | 16 ng | 3.2 ng | 640 pg | 128 pg | 26 pg |
| Protein (pg/ml) | 20.683 | 9.269 | 4.768 | 0 | 0 | 0 | 0 | 0 |

Example 111

Bicistronic Modified mRNA

Human embryonic kidney epithelial (HEK293) were seeded on 96-well plates (Greiner Bio-one GmbH, Frickenhausen, Germany) HEK293 were seeded at a density of 30,000 in 100 μl cell culture medium (DMEM, 10% FCS, adding 2 mM L-Glutamine, 1 mM Sodiumpyruvate and 1× non-essential amino acids (Biochrom AG, Berlin, Germany) and 1.2 mg/ml Sodiumbicarbonate (Sigma-Aldrich, Munich, Germany)) 75 ng of the bi-cistronic modified mRNA (mCherry-2A-GFP) (SEQ ID NO: 33913; polyA tail of approximately 160 nucleotides not shown in sequence; 5'cap, Cap1; fully modified with 5-methylcytosine and pseudouridine), mCherry modified mRNA (mRNA SEQ ID NO: 33898; polyA tail of approximately 160 nucleotides not shown in sequence; 5'cap, Cap1; fully modified with 5-methylcytosine and pseudouridine) or green fluorescent protein (GFP) modified mRNA (mRNA sequence shown in SEQ ID NO: 33909; polyA tail of approximately 160 nucleotides not shown in sequence; 5'cap, Cap1; fully modified with 5-methylcytosine and pseudouridine) were added after seeding the cells and incubated. A control of untreated cells was also evaluated. mCherry-2A-GFP refers to a modified mRNA sequence comprising the coding region of mCherry, the 2A peptide and the coding region of GFP.

Cells were harvested by transferring the culture media supernatants to a 96-well Pro-Bind U-bottom plate (Beckton Dickinson GmbH, Heidelberg, Germany). Cells were trypsinized with ½ volume Trypsin/EDTA (Biochrom AG, Berlin, Germany), pooled with respective supernatants and fixed by adding one volume PBS/2% FCS (both Biochrom AG, Berlin, Germany)/0.5% formaldehyde (Merck, Darmstadt, Germany). Samples then were submitted to a flow cytometer measurement with a 532 nm excitation laser and the 610/20 filter for PE-Texas Red in a LSRII cytometer (Beckton Dickinson GmbH, Heidelberg, Germany). The mean fluorescence intensity (MFI) of all events is shown in Table 174. Cells transfected with the bi-cistronic modified mRNA were able to express both mCherry and GFP.

TABLE 174

MFI of Modified mRNA

| Modified mRNA | mCherry MFI | GFP MFI |
|---|---|---|
| mCherry | 17746 | 427 |
| GFP | 427 | 20019 |
| mCherry-2A-GFP | 5742 | 6783 |
| Untreated | 427 | 219 |

Example 112

Cationic Lipid Formulation Studies of 5-Methylcytosine and N1-Methylpseudouridine Modified mRNA to Produce an Antibody Herceptin heavy chain (HC) modified mRNA (mRNA sequence shown in SEQ ID NO: 33914; polyA tail of approximately 140 nucleotides not shown in sequence; 5'cap, Cap1; fully modified with 5-methylcytosine and N1-methylpseudouridine) and Herceptin light chain (LC) modified mRNA (mRNA sequence shown in SEQ ID NO: 33915; polyA tail of approximately 140 nucleotides not shown in sequence; 5'cap, Cap1; fully modified with 5-methylcytosine and N1-methylpseudouridine) are formulated in DLin-MC3-DMA and DLin-KC2-DMA as described in Table 175. The formulations are administered intravenously (I.V) to Balb-C mice at a dose of 0.500, 0.050, and 0.005 mg/kg.

TABLE 175

DLin-MC3-DMA and DLin-KC2-DMA Formulations

| | Formulation | |
|---|---|---|
| | NPA-158-1 | NPA-159-1 |
| Herceptin HC:LC Ratio (wt/wt) | 2:1 | 2:1 |
| Lipid | DLin-MC3-DMA | DLin-KC2-DMA |
| Lipid/Total mRNA ratio (wt/wt) | 20:1 | 20:1 |
| Mean Size | 129 nm PDI: 0.14 | 100 nm PDI: 0.10 |
| Zeta at pH 7.4 | 0.9 mV | 1.9 mV |
| Encaps. (RiboGr) | 100% | 100% |

Serum was collected from the mice at 8 hours, 24 hours, 72 hours and/or 7 days after administration of the formulation. The serum was analyzed by ELISA to determine the protein expression of Herceptin.

Example 113

Directed SAR of Pseudouridine and N1-methyl-pseudouridine

With the recent focus on the pyrimidine nucleoside pseudouridine, a series of structure-activity studies were designed to investigate mRNA containing modifications to pseudouridine or N1-methyl-pseudourdine.

The study was designed to explore the effect of chain length, increased lipophilicity, presence of ring structures, and alteration of hydrophobic or hydrophilic interactions when modifications were made at the N1 position, C6 position, the 2-position, the 4-position and on the phosphate backbone. Stability is also investigated.

To this end, modifications involving alkylation, cycloalkylation, alkyl-cycloalkylation, arylation, alkyl-arylation, alkylation moieties with amino groups, alkylation moieties with carboxylic acid groups, and alkylation moieties containing amino acid charged moieties are investigated. The degree of alkylation is generally $C_1$-$C_6$. Examples of the chemistry modifications include those listed in Table 176 and Table 177.

TABLE 176

Pseudouridine and N1-methyl-pseudouridine SAR

| Chemistry Modification | Compound # | Naturally occuring |
|---|---|---|
| N1-Modifications | | |
| N1-Ethyl-pseudo-UTP | 1 | N |
| N1-Propyl-pseudo-UTP | 2 | N |
| N1-iso-propyl-pseudo-UTP | 3 | N |
| N1-(2,2,2-Trifluoroethyl)-pseudo-UTP | 4 | N |
| N1-Cyclopropyl-pseudo-UTP | 5 | N |
| N1-Cyclopropylmethyl-pseudo-UTP | 6 | N |
| N1-Phenyl-pseudo-UTP | 7 | N |
| N1-Benzyl-pseudo-UTP | 8 | N |
| N1-Aminomethyl-pseudo-UTP | 9 | N |
| Pseudo-UTP-N1-2-ethanoic acid | 10 | N |
| N1-(3-Amino-3-carboxypropyl)pseudo-UTP | 11 | N |
| N1-Methyl-3-(3-amino-3-carboxypropyl)pseudo-UTP | 12 | Y |
| C-6 Modifications | | |
| 6-Methyl-pseudo-UTP | 13 | N |
| 6-Trifluoromethyl-pseudo-UTP | 14 | N |
| 6-Methoxy-pseudo-UTP | 15 | N |
| 6-Phenyl-pseudo-UTP | 16 | N |
| 6-Iodo-pseudo-UTP | 17 | N |
| 6-Bromo-pseudo-UTP | 18 | N |
| 6-Chloro-pseudo-UTP | 19 | N |
| 6-Fluoro-pseudo-UTP | 20 | N |
| 2- or 4-position Modifications | | |
| 4-Thio-pseudo-UTP | 21 | N |
| 2-Thio-pseudo-UTP | 22 | N |
| Phosphate backbone Modifications | | |
| Alpha-thio-pseudo-UTP | 23 | N |
| N1-Me-alpha-thio-pseudo-UTP | 24 | N |

TABLE 177

Pseudouridine and N1-methyl-pseudouridine SAR

| Chemistry Modification | Compound # | Naturally occurring |
|---|---|---|
| N1-Methyl-pseudo-UTP | 1 | Y |
| N1-Butyl-pseudo-UTP | 2 | N |
| N1-tert-Butyl-pseudo-UTP | 3 | N |
| N1-Pentyl-pseudo-UTP | 4 | N |
| N1-Hexyl-pseudo-UTP | 5 | N |
| N1-Trifluoromethyl-pseudo-UTP | 6 | Y |
| N1-Cyclobutyl-pseudo-UTP | 7 | N |
| N1-Cyclopentyl-pseudo-UTP | 8 | N |
| N1-Cyclohexyl-pseudo-UTP | 9 | N |
| N1-Cycloheptyl-pseudo-UTP | 10 | N |
| N1-Cyclooctyl-pseudo-UTP | 11 | N |
| N1-Cyclobutylmethyl-pseudo-UTP | 12 | N |
| N1-Cyclopentylmethyl-pseudo-UTP | 13 | N |
| N1-Cyclohexylmethyl-pseudo-UTP | 14 | N |
| N1-Cycloheptylmethyl-pseudo-UTP | 15 | N |
| N1-Cyclooctylmethyl-pseudo-UTP | 16 | N |
| N1-p-tolyl-pseudo-UTP | 17 | N |
| N1-(2,4,6-Trimethyl-phenyl)pseudo-UTP | 18 | N |
| N1-(4-Methoxy-phenyl)pseudo-UTP | 19 | N |
| N1-(4-Amino-phenyl)pseudo-UTP | 20 | N |
| N1(4-Nitro-phenyl)pseudo-UTP | 21 | N |
| Pseudo-UTP-N1-p-benzoic acid | 22 | N |

TABLE 177-continued

Pseudouridine and N1-methyl-pseudouridine SAR

| Chemistry Modification | Compound # | Naturally occurring |
|---|---|---|
| N1-(4-Methyl-benzyl)pseudo-UTP | 24 | N |
| N1-(2,4,6-Trimethyl-benzyl)pseudo-UTP | 23 | N |
| N1-(4-Methoxy-benzyl)pseudo-UTP | 25 | N |
| N1-(4-Amino-benzyl)pseudo-UTP | 26 | N |
| N1-(4-Nitro-benzyl)pseudo-UTP | 27 | N |
| Pseudo-UTP-N1-methyl-p-benzoic acid | 28 | N |
| N1-(2-Amino-ethyl)pseudo-UTP | 29 | N |
| N1-(3-Amino-propyl)pseudo-UTP | 30 | N |
| N1-(4-Amino-butyl)pseudo-UTP | 31 | N |
| N1-(5-Amino-pentyl)pseudo-UTP | 32 | N |
| N1-(6-Amino-hexyl)pseudo-UTP | 33 | N |
| Pseudo-UTP-N1-3-propionic acid | 34 | N |
| Pseudo-UTP-N1-4-butanoic acid | 35 | N |
| Pseudo-UTP-N1-5-pentanoic acid | 36 | N |
| Pseudo-UTP-N1-6-hexanoic acid | 37 | N |
| Pseudo-UTP-N1-7-heptanoic acid | 38 | N |
| N1-(2-Amino-2-carboxyethyl)pseudo-UTP | 39 | N |
| N1-(4-Amino-4-carboxybutyl)pseudo-UTP | 40 | N |
| N3-Alkyl-pseudo-UTP | 41 | N |
| 6-Ethyl-pseudo-UTP | 42 | N |
| 6-Propyl-pseudo-UTP | 43 | N |
| 6-iso-Propyl-pseudo-UTP | 44 | N |
| 6-Butyl-pseudo-UTP | 45 | N |
| 6-tert-Butyl-pseudo-UTP | 46 | N |
| 6-(2,2,2-Trifluoroethyl)-pseudo-UTP | 47 | N |
| 6-Ethoxy-pseudo-UTP | 48 | N |
| 6-Trifluoromethoxy-pseudo-UTP | 49 | N |
| 6-Phenyl-pseudo-UTP | 50 | N |
| 6-(Substituted-Phenyl)-pseudo-UTP | 51 | N |
| 6-Cyano-pseudo-UTP | 52 | N |
| 6-Azido-pseudo-UTP | 53 | N |
| 6-Amino-pseudo-UTP | 54 | N |
| 6-Ethylcarboxylate-pseudo-UTP | 54b | N |
| 6-Hydroxy-pseudo-UTP | 55 | N |
| 6-Methylamino-pseudo-UTP | 55b | N |
| 6-Dimethylamino-pseudo-UTP | 57 | N |
| 6-Hydroxyamino-pseudo-UTP | 59 | N |
| 6-Formyl-pseudo-UTP | 60 | N |
| 6-(4-Morpholino)-pseudo-UTP | 61 | N |
| 6-(4-Thiomorpholino)-pseudo-UTP | 62 | N |
| N1-Me-4-thio-pseudo-UTP | 63 | N |
| N1-Me-2-thio-pseudo-UTP | 64 | N |
| 1,6-Dimethyl-pseudo-UTP | 65 | N |
| 1-Methyl-6-trifluoromethyl-pseudo-UTP | 66 | N |
| 1-Methyl-6-ethyl-pseudo-UTP | 67 | N |
| 1-Methyl-6-propyl-pseudo-UTP | 68 | N |
| 1-Methyl-6-iso-propyl-pseudo-UTP | 69 | N |
| 1-Methyl-6-butyl-pseudo-UTP | 70 | N |
| 1-Methyl-6-tert-butyl-pseudo-UTP | 71 | N |
| 1-Methyl-6-(2,2,2-Trifluoroethyl)pseudo-UTP | 72 | N |
| 1-Methyl-6-iodo-pseudo-UTP | 73 | N |
| 1-Methyl-6-bromo-pseudo-UTP | 74 | N |
| 1-Methyl-6-chloro-pseudo-UTP | 75 | N |
| 1-Methyl-6-fluoro-pseudo-UTP | 76 | N |
| 1-Methyl-6-methoxy-pseudo-UTP | 77 | N |
| 1-Methyl-6-ethoxy-pseudo-UTP | 78 | N |
| 1-Methyl-6-trifluoromethoxy-pseudo-UTP | 79 | N |
| 1-Methyl-6-phenyl-pseudo-UTP | 80 | N |
| 1-Methyl-6-(substituted phenyl)pseudo-UTP | 81 | N |
| 1-Methyl-6-cyano-pseudo-UTP | 82 | N |
| 1-Methyl-6-azido-pseudo-UTP | 83 | N |
| 1-Methyl-6-amino-pseudo-UTP | 84 | N |
| 1-Methyl-6-ethylcarboxylate-pseudo-UTP | 85 | N |
| 1-Methyl-6-hydroxy-pseudo-UTP | 86 | N |
| 1-Methyl-6-methylamino-pseudo-UTP | 87 | N |
| 1-Methyl-6-dimethylamino-pseudo-UTP | 88 | N |
| 1-Methyl-6-hydroxyamino-pseudo-UTP | 89 | N |
| 1-Methyl-6-formyl-pseudo-UTP | 90 | N |
| 1-Methyl-6-(4-morpholino)-pseudo-UTP | 91 | N |
| 1-Methyl-6-(4-thiomorpholino)-pseudo-UTP | 92 | N |
| 1-Alkyl-6-vinyl-pseudo-UTP | 93 | N |

TABLE 177-continued

Pseudouridine and N1-methyl-pseudouridine SAR

| Chemistry Modification | Compound # | Naturally occurring |
|---|---|---|
| 1-Alkyl-6-allyl-pseudo-UTP | 94 | N |
| 1-Alkyl-6-homoallyl-pseudo-UTP | 95 | N |
| 1-Alkyl-6-ethynyl-pseudo-UTP | 96 | N |
| 1-Alkyl-6-(2-propynyl)-pseudo-UTP | 97 | N |
| 1-Alkyl-6-(1-propynyl)-pseudo-UTP | 98 | N |

Example 114

Incorporation of Naturally and Non-Naturally Occurring Nucleosides

Naturally and non-naturally occurring nucleosides are incorporated into mRNA encoding a polypeptide of interest. Examples of these are given in Tables 178 and 179. Certain commercially available nucleoside triphosphates (NTPs) are investigated in the polynucleotides of the invention. A selection of these are given in Table 179. The resultant mRNA are then examined for their ability to produce protein, induce cytokines, and/or produce a therapeutic outcome.

TABLE 178

Naturally and non-naturally occurring nucleosides

| Chemistry Modification | Compound # | Naturally occuring |
|---|---|---|
| N4-Methyl-Cytosine | 1 | Y |
| N4,N4-Dimethyl-2'-OMe-Cytosine | 2 | Y |
| 5-Oxyacetic acid-methyl ester-Uridine | 3 | Y |
| N3-Methyl-pseudo-Uridine | 4 | Y |
| 5-Hydroxymethyl-Cytosine | 5 | Y |
| 5-Trifluoromethyl-Cytosine | 6 | N |
| 5-Trifluoromethyl-Uridine | 7 | N |
| 5-Methyl-amino-methyl-Uridine | 8 | Y |
| 5-Carboxy-methyl-amino-methyl-Uridine | 9 | Y |
| 5-Carboxymethylaminomethyl-2'-OMe-Uridine | 10 | Y |
| 5-Carboxymethylaminomethyl-2-thio-Uridine | 11 | Y |
| 5-Methylaminomethyl-2-thio-Uridine | 12 | Y |
| 5-Methoxy-carbonyl-methyl-Uridine | 13 | Y |
| 5-Methoxy-carbonyl-methyl-2'-OMe-Uridine | 14 | Y |
| 5-Oxyacetic acid-Uridine | 15 | Y |
| 3-(3-Amino-3-carboxypropyl)-Uridine | 16 | Y |
| 5-(carboxyhydroxymethyl)uridine methyl ester | 17 | Y |
| 5-(carboxyhydroxymethyl)uridine | 18 | Y |

TABLE 179

Non-naturally occurring nucleoside triphosphates

| Chemistry Modification | Compound # | Naturally occuring |
|---|---|---|
| N1-Me-GTP | 1 | N |
| 2'-OMe-2-Amino-ATP | 2 | N |
| 2'-OMe-pseudo-UTP | 3 | Y |
| 2'-OMe-6-Me-UTP | 4 | N |
| 2'-Azido-2'-deoxy-ATP | 5 | N |
| 2'-Azido-2'-deoxy-GTP | 6 | N |
| 2'-Azido-2'-deoxy-UTP | 7 | N |
| 2'-Azido-2'-deoxy-CTP | 8 | N |
| 2'-Amino-2'-deoxy-ATP | 9 | N |
| 2'-Amino-2'-deoxy-GTP | 10 | N |
| 2'-Amino-2'-deoxy-UTP | 11 | N |
| 2'-Amino-2'-deoxy-CTP | 12 | N |
| 2-Amino-ATP | 13 | N |
| 8-Aza-ATP | 14 | N |

TABLE 179-continued

Non-naturally occurring nucleoside triphosphates

| Chemistry Modification | Compound # | Naturally occuring |
|---|---|---|
| Xanthosine-5'-TP | 15 | N |
| 5-Bromo-CTP | 16 | N |
| 2'-F-5-Methyl-2'-deoxy-UTP | 17 | N |
| 5-Aminoallyl-CTP | 18 | N |
| 2-Amino-riboside-TP | 19 | N |

Example 115

Incorporation of Modifications to the Nucleobase and Carbohydrate (Sugar)

Naturally and non-naturally occurring nucleosides are incorporated into mRNA encoding a polypeptide of interest. Commercially available nucleosides and NTPs having modifications to both the nucleobase and carbohydrate (sugar) are examined for their ability to be incorporated into mRNA and to produce protein, induce cytokines, and/or produce a therapeutic outcome. Examples of these nucleosides are given in Tables 180 and 181.

TABLE 180

Combination modifications

| Chemistry Modification | Compound # |
|---|---|
| 5-iodo-2'-fluoro-deoxyuridine | 1 |
| 5-iodo-cytidine | 6 |
| 2'-bromo-deoxyuridine | 7 |
| 8-bromo-adenosine | 8 |
| 8-bromo-guanosine | 9 |
| 2,2'-anhydro-cytidine hydrochloride | 10 |
| 2,2'-anhydro-uridine | 11 |
| 2'-Azido-deoxyuridine | 12 |
| 2-amino-adenosine | 13 |
| N4-Benzoyl-cytidine | 14 |
| N4-Amino-cytidine | 15 |
| 2'-O-Methyl-N4-Acetyl-cytidine | 16 |
| 2'Fluoro-N4-Acetyl-cytidine | 17 |
| 2'Fluor-N4-Bz-cytidine | 18 |
| 2'O-methyl-N4-Bz-cytidine | 19 |
| 2'O-methyl-N6-Bz-deoxyadenosine | 20 |
| 2'Fluoro-N6-Bz-deoxyadenosine | 21 |
| N2-isobutyl-guanosine | 22 |
| 2'Fluro-N2-isobutyl-guanosine | 23 |
| 2'O-methyl-N2-isobutyl-guanosine | 24 |

TABLE 181

Naturally occuring combinations

| Name | Compound # | Naturally occuring |
|---|---|---|
| 5-Methoxycarbonylmethyl-2-thiouridine TP | 1 | Y |
| 5-Methylaminomethyl-2-thiouridine TP | 2 | Y |
| 5-Crbamoylmethyluridine TP | 3 | Y |
| 5-Carbamoylmethyl-2'-O-methyluridine TP | 4 | Y |
| 1-Methyl-3-(3-amino-3-carboxypropyl) pseudouridine TP | 5 | Y |
| 5-Methylaminomethyl-2-selenouridine TP | 6 | Y |
| 5-Carboxymethyluridine TP | 7 | Y |
| 5-Methyldihydrouridine TP | 8 | Y |
| lysidine TP | 9 | Y |
| 5-Taurinomethyluridine TP | 10 | Y |
| 5-Taurinomethyl-2-thiouridine TP | 11 | Y |
| 5-(iso-Pentenylaminomethyl)uridine TP | 12 | Y |

TABLE 181-continued

Naturally occuring combinations

| Name | Compound # | Naturally occurring |
|---|---|---|
| 5-(iso-Pentenylaminomethyl)-2-thiouridine TP | 13 | Y |
| 5-(iso-Pentenylaminomethyl)-2'-O-methyluridine TP | 14 | Y |
| N4-Acetyl-2'-O-methylcytidine TP | 15 | Y |
| N4,2'-O-Dimethylcytidine TP | 16 | Y |
| 5-Formyl-2'-O-methylcytidine TP | 17 | Y |
| 2'-O-Methylpseudouridine TP | 18 | Y |
| 2-Thio-2'-O-methyluridine TP | 19 | Y |
| 3,2'-O-Dimethyluridine TP | 20 | Y |

In the tables "UTP" stands for uridine triphosphate, "GTP" stands for guanosine triphosphate, "ATP" stands for adenosine triphosphate, "CTP" stands for cytosine triphosphate, "TP" stands for triphosphate and "Bz" stands for benzyl.

Example 116

Dose Response and Injection Site Selection and Timing

To determine the dose response trends, impact of injection site and impact of injection timing, studies are performed following the protocol outlined in Example 35. In these studies, varied doses of 1 ug, 5 ug, 10 ug, 25 ug, 50 ug, and values in between are used to determine dose response outcomes. Split dosing for a 100 ug total dose includes three or six doses of 1.6 ug, 4.2 ug, 8.3 ug, 16.6 ug, or values and total doses equal to administration of the total dose selected.

Injection sites are chosen from the limbs or any body surface presenting enough area suitable for injection. This may also include a selection of injection depth to target the dermis (Intradermal), epidermis (Epidermal), subcutaneous tissue (SC) or muscle (IM). Injection angle will vary based on targeted delivery site with injections targeting the intradermal site to be 10-15 degree angles from the plane of the surface of the skin, between 20-45 degrees from the plane of the surface of the skin for subcutaneous injections and angles of between 60-90 degreees for injections substantially into the muscle.

Example 117

Intranasal Lung Delivery of 1-Methylpseudouridine or 5-Methylcytosine and 1-Methylpseudouridine Modified Luciferase mRNA Formulated in Cationic Lipid Nanoparticle Luciferase modified mRNA (mRNA sequence shown in SEQ ID NO: 33907; polyA tail of approximately 140 nucleotides not shown in sequence; 5'cap, Cap1) fully modified with 1-methylpseudouridine (Luc-G5-LNP-KC2) or fully modified with 1-methylpseudouridine and 5-methylcytosine (Luc-G2-LNP-KC2) were formulated in the cationic Lipid Nanoparticle (LNP-KC2). The formulations were administered intranasally (I.N.) to Balb-C mice at a dose of 0.3 mg/kg. Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours, 48, and 72 hours after dosing and the average total flux (photons/second) was measured. The background flux was about 6.3+05 p/s. The results of the imaging of Luc-G5-LNP-KC2 or Luc-G5-LNP-KC2 vs. Vehicle are shown in the Table 182, "NT" means not tested.

TABLE 182

Luciferase expression after intranasal dosing

| Route | Time Point | Luc-G5-LNP-KC2 Flux (p/s) | Luc-G2-LNP-KC2 Flux (p/s) | Vehicle (PBS) Flux (p/s) |
|---|---|---|---|---|
| I.N. | 2 hrs | 1.53E+06 | 5.81E+05 | 3.87E+05 |
| I.N. | 8 hrs | 1.09E+07 | 9.35E+05 | 5.57E+05 |
| I.N. | 24 hrs | 5.93E+06 | 5.33E+05 | 4.89E+05 |
| I.N. | 28 hrs | 1.22E+06 | 7.63E+05 | 8.81E+05 |
| I.N. | 72 hrs | 8.43E+05 | NT | 8.17E+05 |

Example 118

Intranasal Lung Delivery of 1-Methylpseudouridine or 5-Methylcytosine and 1-Methylpseudouridine Modified Luciferase mRNA Lipoplexed in Lipofectamine 2000

Luciferase modified mRNA (mRNA sequence shown in SEQ ID NO: 33907; polyA tail of approximately 140 nucleotides not shown in sequence; 5'cap, Cap1) fully modified with 1-methylpseudouridine (Luc-G5-Lipoplex) or fully modified with 1-methylpseudouridine and 5-methylcytosine (Luc-G2-Lipoplex) were lipoplexed in two steps, first step was the dilution of 16.6 ul from 3 mg/ml of G5 or G2 modified luciferase mRNA in 108.5 ul DMEM and the second step was the dilution of 100 ul LF2000 in 25 ul DMEM then both mixed together gently to make 250 ul total mixer which incubated 5-10 min at RT to form a Lipid-mRNA complex before injection. The lipoplex from both Luciferase mRNA fully modified with 1-methylpseudouridine or 1-methylpseudouridine and 5-methylcytosine were administered intranasally (I.N.) to Balb-C mice at a dose of 0.5 mg/kg.

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours and 24 hours after dosing and the average total flux (photons/second) was measured. The background signal was about 4.8+05 p/s. The background flux was about 6.3+05 p/s. The results of the imaging of Luc-G5-Lipoplex or Luc-G2-Lipoplex vs. Vehicle are shown in the Table 183.

TABLE 183

Luciferase expression after intranasal dosing

| Route | Time Point | Luc-G5-Lipoplex Flux (p/s) | Luc-G2-Lipoplex Flux (p/s) | Vehicle (PBS) Flux (p/s) |
|---|---|---|---|---|
| I.N. | 2 hrs | 8.37E+05 | 9.58E+05 | 3.87E+05 |
| I.N. | 8 hrs | 8.42E+05 | 7.11E+05 | 5.57E+05 |
| I.N. | 24 hrs | 5.74E+05 | 5.53E+05 | 4.89E+05 |

Example 119

Intranasal Lung Delivery of 1-Methylpseudouridine or 5-Methylcytosine and 1-Methylpseudouridine Modified Luciferase mRNA Formulated in PBS Luciferase modified mRNA (mRNA sequence shown in SEQ ID NO: 33907; polyA tail of approximately 140 nucleotides not shown in sequence; 5'cap, Cap1) fully modified with 1-methylpseudouridine (Luc-G5-Buffer(PBS)) or fully modified with 1-methylpseudouridine and 5-methylcytosine (Luc-G2-Buffer(PBS)) formulated in PBS (pH 7.4) were administered intranasally (I.N.) to Balb-C mice at a dose of 7.5 mg/kg.

Twenty minutes prior to imaging, mice were injected intraperitoneally with a D-luciferin solution at 150 mg/kg. Animals were then anesthetized and images were acquired with an IVIS Lumina II imaging system (Perkin Elmer). Bioluminescence was measured as total flux (photons/second) of the entire mouse. The mice were imaged at 2 hours, 8 hours and 24 hours after dosing and the average total flux (photons/second) was measured. The background flux was about 4.8+05 p/s. The background flux was about 6.3+05 p/s. The results of the imaging of Luc-G5-in Buffer vs. Vehicle are shown in the Table 184.

TABLE 184

Luciferase expression after intranasal dosing

| Route | Time Point | Luc-G5-in Buffer (PBS) Flux [p/s] | Luc-G2-in Buffer (PBS) Flux [p/s] | Vehicle (PBS) Flux (p/s) |
|---|---|---|---|---|
| I.N. | 2 hrs | 4.50E+05 | 9.58E+05 | 3.87E+05 |
| I.N. | 8 hrs | 7.12E+05 | 7.11E+05 | 5.57E+05 |
| I.N. | 24 hrs | 4.47E+05 | 5.53E+05 | 4.89E+05 |

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

Lengthy Table

The patent application contains a lengthy table section. A copy of the table is available in electronic form from the USPTO web site. An electronic copy of the table will also be available from the USPTO upon request and payment of the fee set forth in 37 CFR 1.19(b)(3).

SEQUENCE LISTING (33915 sequences)

SEQ ID NO: 1 - DNA, 47 bp, Homo sapiens
gggaaataagagagaaaagaagagtaagaagaaatataagagccacc

SEQ ID NO: 2 - DNA, 47 bp, Homo sapiens
gggagatcagagagaaaagaagagtaagaagaaatataagagccacc

SEQ ID NO: 3 - DNA, 145 bp, Homo sapiens
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 4 - RNA, 42 nt, Homo sapiens
gggagacaagcuuggcauuccgguacuguugguaaagccacc

SEQ ID NO: 5 - DNA, 371 bp, Homo sapiens
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 6 - DNA, 568 bp, Homo sapiens
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 7 - DNA, 289 bp, Homo sapiens
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 8 - DNA, 379 bp, Homo sapiens
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 9 - DNA, 118 bp, Mus sp.
gctgccttctgcggggcttgccttctggccatgcccttcttctctcccttgcacctgtacctcttggtctttgaataaagcctgagtaggaaggcggccgctcgagcatgcatctaga

SEQ ID NO: 10 - DNA, 908 bp, Homo sapiens
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 11 - DNA, 835 bp, Homo sapiens
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 12 - DNA, 297 bp, Homo sapiens
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 13 - DNA, 602 bp, Homo sapiens
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 14 - DNA, 785 bp, Homo sapiens
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 15 - DNA, 3001 bp, Homo sapiens
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 16 - DNA, 1037 bp, Homo sapiens
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 17 - DNA, 577 bp, Homo sapiens
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 18 - DNA, 2212 bp, Homo sapiens
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 19 - DNA, 729 bp, Homo sapiens
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 20 - DNA, 847 bp, Homo sapiens
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 21 - DNA, 110 bp, Homo sapiens
gctggagcctcggtggccatgcttcttgccccttgggcctccccccagcccctcctccccttcctgcacccgtacccccgtggtctttgaataaagtctgagtgggcggc

SEQ ID NO: 22 - DNA, 27 bp, Homo sapiens
ttggaccctcgtacagaagctaatacg

SEQ ID NO: 23 - DNA, 189 bp, Homo sapiens
ttttttttttttttttttttttttttttttttttttttttttttttttttttttttttttttttttttttttttttttttttttttttttttttttttttttttttttttttttttttttttttttttttttttttttttttttttttttttttttttttcttcctactcaggctttattcaaagacca

SEQ ID NO: 24 - DNA, 20 bp, Homo sapiens
ccttgaccttctggaacttc

SEQ ID NO: 25 - DNA, 20 bp, Homo sapiens
ccaagcactgaaacggatat

SEQ ID NO: 26 - DNA, 20 bp, Homo sapiens
gatgaaaagtgctccaagga

SEQ ID NO: 27 - DNA, 20 bp, Homo sapiens
aaccgtgatgaaaaggtacc

SEQ ID NO: 28 - DNA, 20 bp, Homo sapiens
tcatgcagattggaaaggtc

SEQ ID NO: 29 - DNA, 20 bp, Homo sapiens
cttcttggactgtccagagg

SEQ ID NO: 30 - DNA, 20 bp, Homo sapiens
gcagtccctgatacaagaac

SEQ ID NO: 31 - DNA, 20 bp, Homo sapiens
gattgaaggtggctcgctac

SEQ ID NO: 32 - DNA, 75 bp, Homo sapiens
atgatgccatcctcagtctcatggggtattttgctcttggcgggtctgtgctgtctcgtgccggtgtcgctcgca

SEQ ID NO: 33 - DNA, 90 bp, Homo sapiens
atggccggaccggcgactcagtcgcccatgaaactcatggccctgcagttgttgctttggcactcagccctctggaccgtccaagaggcg

SEQ ID NO: 34 - DNA, 137 bp, Homo sapiens
atgcagagagtgaacatgattatggccgagtccccatcgctcatcacaatctgcctgcttggtacctgctttccgccgaatgcactgtctttctggatcacgagaatgcgaataagatcttgaaccgacccaaacgg

SEQ ID NO: 35 - DNA, 63 bp, Homo sapiens
atgaaaggatcattgctgttgctcctcgtgtcgaaccttctgctttgccagtccgtagccccc

SEQ ID NO: 36 - DNA, 72 bp, Homo sapiens
atgaaatgggtgacgttcatctcactgttgtttttgttctcgtccgcctactccaggggagtattccgccga

SEQ ID NO: 37 - DNA, 63 bp, Homo sapiens
atgtggtggcggctctggtggctgctcctgttgctcctcttgctgtggcccatggtgtgggca

SEQ ID NO: 38 - DNA, 95 bp, Homo sapiens
tgctctttaacctccgcatcctgttgaataacgctgcgttccgaaatgggcataacttcatggtacgcaacttcagatgcggccagccactccag

SEQ ID NO: 39 - DNA, 87 bp, Homo sapiens
atgtccgtcttgacacccctgctcttgagagggctgacggggtccgctagacgcctgccggtaccgcgagcgaagatccactccctg

SEQ ID NO: 40 - DNA, 87 bp, Homo sapiens
atgagcgtgctcactccgttgcttcttcgagggcttacgggatcggctcggaggttgcccgtcccgagagcgaagatccattcgttg

SEQ ID NO: 41 - DNA, 175 bp, Unknown
  Description of Unknown: Bacterial signal sequence
tgacaaaaataactttatctccccagaattttagaatccaaaaacaggaaaccacactactaaaagaaaaatcaaccgagaaaaattctttagcaaaaagtattctcgcagtaaaaatcacttcatcgaattaaggtcaaaattatcggaacgttttatttcgcataagaacact

SEQ ID NO: 42 - DNA, 69 bp, Unknown
  Description of Unknown: Viral signal sequence
atgctgagctttgtggatacccgcaccctgctgctgctggcggtgaccagctgcctggcgacctgccag

SEQ ID NO: 43 - DNA, 96 bp, Unknown
  Description of Unknown: Viral signal sequence
atgggcagcagccaggcgccgcgcatgggcagcgtgggcggccatggcctgatggcgctgctgatggcgggcctgattctgccgggcattctggcg

SEQ ID NO: 44 - DNA, 51 bp, Unknown
  Description of Unknown: Viral signal sequence
atggcgggcattttttattttctgtttagctttctgtttggcatttgcgat

SEQ ID NO: 45 - DNA, 66 bp, Unknown
  Description of Unknown: Viral signal sequence
atggaaaaccgcctgctgcgcgtgtttctggtgtgggcggcgctgaccatggatggcgcgagcgcg

SEQ ID NO: 46 - DNA, 81 bp, Unknown
  Description of Unknown: Viral signal sequence
atggcgcgccagggctgctttggcagctatcaggtgattagcctgtttacctttgcgattggcgtgaacctgtgcctgggc

SEQ ID NO: 47 - DNA, 57 bp, Unknown
  Description of Unknown: Bacterial signal sequence
atgagccgcctgccggtgctgctgctgctgcagctgctggtgcgcccgggcctgcag

SEQ ID NO: 48 - DNA, 87 bp, Unknown
  Description of Unknown: Bacterial signal sequence
atgaaacagcagaaacgcctgtatgcgcgcctgctgaccctgctgtttgcgctgatttttctgctgccgcatagcagcgcgagcgcg

SEQ ID NO: 49 - DNA, 78 bp, Homo sapiens
atggcgacgccgctgcctccgccctccccgcggcacctgcggctgctgcggctgctgctctccgccctcgtcctcggc

SEQ ID NO: 50 - DNA, 54 bp, Homo sapiens
atgaaggctccgggtcggctcgtgctcatcatcctgtgctccgtggtcttctct

SEQ ID NO: 51 - DNA, 45 bp, Homo sapiens
atgcttcagctttggaaacttgttctcctgtgcggcgtgctcact

SEQ ID NO: 52 - DNA, 39 bp, Homo sapiens
atgctttatctccagggttggagcatgcctgctgtggca

SEQ ID NO: 53 - DNA, 144 bp, Homo sapiens
atggataacgtgcagccgaaaataaaacatcgccccttctgcttcagtgtgaaaggccacgtgaagatgctgcggctggatattatcaactcactggtaacaacagtattcatgctcatcgtatctgtgttggcactgatacca

SEQ ID NO: 54 - DNA, 96 bp, Homo sapiens
atgccctgcctagaccaacagctcactgttcatgccctaccctgccctgcccagccctcctctctggccttctgccaagtggggttcttaacagca

SEQ ID NO: 55 - DNA, 138 bp, Homo sapiens
atgaaaaccttgttcaatccagcccctgccattgctgacctggatccccagttctacaccctctcagatgtgttctgctgcaatgaaagtgaggctgagattttaactggcctcacggtgggcagcgctgcagatgct

SEQ ID NO: 56 - DNA, 57 bp, Homo sapiens
atgaagcctctccttgttgtgtttgtctttcttttcctttgggatccagtgctggca

SEQ ID NO: 57 - DNA, 63 bp, Homo sapiens
atgtcctgttccctaaagtttactttgattgtaatttttttttactgttggctttcatccagc

SEQ ID NO: 58 - DNA, 210 bp, Homo sapiens
atggttcttactaaacctcttcaaagaaatggcagcatgatgagctttgaaaatgtgaaagaaaagagcagagaaggagggccccatgcacacacacccgaagaagaattgtgtttcgtggtaacacactaccctcaggttcagaccacactcaacctgtttttccatatattcaaggttcttactcaaccactttcccttctgtggggt

SEQ ID NO: 59 - DNA, 96 bp, Homo sapiens
atggccaccccgccattccggctgataaggaagatgttttccttcaaggtgagcagatggatggggcttgcctgcttccggtccctggcggcatcc

SEQ ID NO: 60 - DNA, 87 bp, Homo sapiens
atgagctttttccaactcctgatgaaaaggaaggaactcattcccttggtggtgttcatgactgtggcggcgggtggagcctcatct

SEQ ID NO: 61 - DNA, 123 bp, Homo sapiens
atggtctcagctctgcggggagcacccctgatcagggtgcactcaagccctgtttcttctccttctgtgagtggaccacggaggctggtgagctgcctgtcatcccaaagctcagctctgagc

SEQ ID NO: 62 - DNA, 60 bp, Homo sapiens
atgatggggtccccagtgagtcatctgctggccggcttctgtgtgtgggtcgtcttgggc

SEQ ID NO: 63 - DNA, 69 bp, Homo sapiens
atggcaagcatggctgccgtgctcacctgggctctggctcttctttcagcgttttcggccacccaggca

SEQ ID NO: 64 - DNA, 135 bp, Homo sapiens
atggtgctcatgtggaccagtggtgacgccttcaagacggcctacttcctgctgaagggtgcccctctgcagttctccgtgtgcggcctgctgcaggtgctggtggacctggccatcctggggcaggcctacgcc

SEQ ID NO: 65 - DNA, 204 bp, Homo sapiens
atggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttcc

SEQ ID NO: 66 - DNA, 147 bp, Homo sapiens
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagcc

SEQ ID NO: 67 - DNA, 45 bp, Homo sapiens
atgggtctgctccttcccctggcactctgcatcctagtcctgtgc

SEQ ID NO: 68 - DNA, 78 bp, Homo sapiens
atggggatccagacgagccccgtcctgctggcctccctgggggtggggctggtcactctgctcggcctggctgtgggc

SEQ ID NO: 69 - DNA, 75 bp, Homo sapiens
atgtcggacctgctactactgggcctgattgggggcctgactctcttactgctgctgacgctgctagcctttgcc

SEQ ID NO: 70 - DNA, 87 bp, Homo sapiens
atggagactgtggtgattgttgccataggtgtgctggccaccatgtttctggcttcgtttgcagccttggtgctggtttgcaggcag

SEQ ID NO: 71 - DNA, 105 bp, Homo sapiens
atgcgcggctctgtggagtgcacctggggttgggggcactgtgcccccagccccctgctcctttggactctacttctgtttgcagccccatttggcctgctgggg

SEQ ID NO: 72 - DNA, 171 bp, Homo sapiens
atgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcc

SEQ ID NO: 73 - DNA, 108 bp, Homo sapiens
atggccctgccccagatgtgtgacgggagccacttggcctccaccctccgctattgcatgacagtcagcggcacagtggttctggtggccgggacgctctgcttcgct

SEQ ID NO: 74 - DNA, 63 bp, Unknown
  Description of Unknown: Bacterial signal sequence
tgaaaaagtggttcgttgctgccggcatcggcgctgccggactcatgctctccagcgccgcca

SEQ ID NO: 75 - DNA, 63 bp, Unknown
  Description of Unknown: Bacterial signal sequence
atgaaacagagcaccattgcgctggcgctgctgccgctgctgtttaccccggtgaccaaagcg

SEQ ID NO: 76 - DNA, 63 bp, Unknown
  Description of Unknown: Bacterial signal sequence
atgaaaaaaaccgcgattgcgattgcggtggcgctggcgggctttgcgaccgtggcgcaggcg

SEQ ID NO: 77 - DNA, 63 bp, Unknown
  Description of Unknown: Bacterial signal sequence
atgaaaaaactgatgctggcgattttttttagcgtgctgagctttccgagctttagccagagc

SEQ ID NO: 78 - DNA, 69 bp, Unknown
  Description of Unknown: Bacterial signal sequence
atgaaaaaaaacattgcgtttctgctggcgagcatgtttgtgtttagcattgcgaccaacgcgtatgcg

SEQ ID NO: 79 - DNA, 96 bp, Homo sapiens
atgtttgcgaaacgctttaaaaccagcctgctgccgctgtttgcgggctttctgctgctgtttcatctggtgctggcgggcccggcggcggcgagc

SEQ ID NO: 80 - DNA, 57 bp, Homo sapiens
atgcgctttccgagcatttttaccgcggtgctgtttgcggcgagcagcgcgctggcg

SEQ ID NO: 81 - DNA, 57 bp, Homo sapiens
atgcgctttccgagcatttttaccaccgtgctgtttgcggcgagcagcgcgctggcg

SEQ ID NO: 82 - DNA, 57 bp, Homo sapiens
atgcgctttccgagcatttttaccagcgtgctgtttgcggcgagcagcgcgctggcg

SEQ ID NO: 83 - DNA, 57 bp, Homo sapiens
atgcgctttccgagcatttttacccatgtgctgtttgcggcgagcagcgcgctggcg

SEQ ID NO: 84 - DNA, 57 bp, Homo sapiens
atgcgctttccgagcatttttaccattgtgctgtttgcggcgagcagcgcgctggcg

SEQ ID NO: 85 - DNA, 57 bp, Homo sapiens
atgcgctttccgagcatttttacctttgtgctgtttgcggcgagcagcgcgctggcg

SEQ ID NO: 86 - DNA, 57 bp, Homo sapiens
atgcgctttccgagcatttttaccgaagtgctgtttgcggcgagcagcgcgctggcg

SEQ ID NO: 87 - DNA, 57 bp, Homo sapiens
atgcgctttccgagcatttttaccggcgtgctgtttgcggcgagcagcgcgctggcg

SEQ ID NO: 88 - DNA, 63 bp, Homo sapiens
atgcgttcctcccccctcctccgctccgccgttgtggccgccctgccggtgttggcccttgcc

SEQ ID NO: 89 - DNA, 66 bp, Homo sapiens
atgggcgcggcggccgtgcgctggcacttgtgcgtgctgctggccctgggcacacgcgggcggctg

SEQ ID NO: 90 - DNA, 53 bp, Artificial Sequence
  Description of Artificial Sequence: Synthetic signal sequence
atgaggagctcccttgtgctgttctttgtctctgcgtggacggccttggccag

SEQ ID NO: 91 - DNA, 96 bp, Homo sapiens
atgctcaggggtccgggacccgggcggctgctgctgctagcagtcctgtgcctggggacatcggtgcgctgcaccgaaaccgggaagagcaagagg

SEQ ID NO: 92 - DNA, 69 bp, Homo sapiens
atgcttaggggtccggggcccgggctgctgctgctggccgtccagctggggacagcggtgccctccacg

SEQ ID NO: 93 - DNA, 93 bp, Homo sapiens
atgcgccggggggccctgaccgggctgctcctggtcctgtgcctgagtgttgtgctacgtgcagccccctctgcaacaagcaagaagcgcagg

SEQ ID NO: 94 - protein, 24 aa, Homo sapiens
MMPSSVSWGILLAGLCCLVPVSLA

SEQ ID NO: 95 - protein, 30 aa, Homo sapiens
MAGPATQSPMKLMALQLLLWHSALWTVQEA

SEQ ID NO: 96 - protein, 46 aa, Homo sapiens
MQRVNMIMAESPSLITICLLGYLLSAECTVFLDHENANKILNRPKR

SEQ ID NO: 97 - protein, 21 aa, Homo sapiens
MKGSLLLLLVSNLLLCQSVAP

SEQ ID NO: 98 - protein, 24 aa, Homo sapiens
MKWVTFISLLFLFSSAYSRGVFRR

SEQ ID NO: 99 - protein, 19 aa, Homo sapiens
MWWRLWWLLLLLLLLPMWA

SEQ ID NO: 100 - protein, 32 aa, Homo sapiens
MLFNLRILLNNAAFRNGHNFMVRNFRCGQPLQ

SEQ ID NO: 101 - protein, 29 aa, Homo sapiens
MSVLTPLLLRGLTGSARRLPVPRAKIHSL

SEQ ID NO: 102 - protein, 29 aa, Homo sapiens
MSVLTPLLLRGLTGSARRLPVPRAKIHSL

SEQ ID NO: 103 - protein, 59 aa, Unknown
  Description of Unknown: Bacterial signal sequence
VTKITLSPQNFRIQKQETTLLKEKSTEKNSLAKSILAVKNHFIELRSKLSERFISHKNT

SEQ ID NO: 104 - protein, 23 aa, Unknown
  Description of Unknown: Viral signal sequence
MLSFVDTRTLLLLAVTSCLATCQ

SEQ ID NO: 105 - protein, 32 aa, Unknown
  Description of Unknown: Viral signal sequence
MGSSQAPRMGSVGGHGLMALLMAGLILPGILA

SEQ ID NO: 106 - protein, 17 aa, Unknown
  Description of Unknown: Viral signal sequence
MAGIFYFLFSFLFGICD

SEQ ID NO: 107 - protein, 22 aa, Unknown
  Description of Unknown: Viral signal sequence
MENRLLRVFLVWAALTMDGASA

SEQ ID NO: 108 - protein, 27 aa, Unknown
  Description of Unknown: Viral signal sequence
MARQGCFGSYQVISLFTFAIGVNLCLG

SEQ ID NO: 109 - protein, 19 aa, Unknown
  Description of Unknown: Bacterial signal sequence
MSRLPVLLLLQLLVRPGLQ

SEQ ID NO: 110 - protein, 29 aa, Unknown
  Description of Unknown: Bacterial signal sequence
MKQQKRLYARLLTLLFALIFLLPHSSASA

SEQ ID NO: 111 - protein, 22 aa, Homo sapiens
MATPLPPPSPRHLRLLRLLLSG

SEQ ID NO: 112 - protein, 18 aa, Homo sapiens
MKAPGRLVLIILCSVVFS

SEQ ID NO: 113 - protein, 13 aa, Homo sapiens
MLQLWKLLCGVLT

SEQ ID NO: 114 - protein, 13 aa, Homo sapiens
MLYLQGWSMPAVA

SEQ ID NO: 115 - protein, 48 aa, Homo sapiens
MDNVQPKIKHRPFCFSVKGHVKMLRLDIINSLVTTVFMLIVSVLALIP

SEQ ID NO: 116 - protein, 32 aa, Homo sapiens
MPCLDQQLTVHALPCPAQPSSLAFCQVGFLTA

SEQ ID NO: 117 - protein, 46 aa, Homo sapiens
MKTLFNPAPAIADLDPQFYTLSDVFCCNESEAEILTGLTVGSAADA

SEQ ID NO: 118 - protein, 19 aa, Homo sapiens
MKPLLVVFVFLFLWDPVLA

SEQ ID NO: 119 - protein, 21 aa, Homo sapiens [sequence omitted]

SEQ ID NO: 120 - protein, 70 aa, Homo sapiens
MVLTKPLQRNGSMMSFENVKEKSREGGPHAHTPEEELCFVVTHTPQVQTTLNLFFHIFKVLTQPLSLLWG

SEQ ID NO: 121 - protein, 32 aa, Homo sapiens
MATPPFRLIRKMFSFKVSRWMGLACFRSLAAS

SEQ ID NO: 122 - protein, 29 aa, Homo sapiens
MSFFQLLMKRKELIPLVVFMTVAAGGASS

SEQ ID NO: 123 - protein, 41 aa, Homo sapiens
MVSALRGAPLIRVHSSPVSSPSVSGPAALVSCLSSQSSALS

SEQ ID NO: 124 - protein, 20 aa, Homo sapiens
MMGSPVSHLLAGFCVWVVLG

SEQ ID NO: 125 - protein, 23 aa, Homo sapiens
MASMAAVLTWALALLSAFSATQA

SEQ ID NO: 126 - protein, 45 aa, Homo sapiens
MVLMWTSGDAFKTAYFLLKGAPLQFSVCGLLQVLVDLAILGQATA

SEQ ID NO: 127 - protein, 68 aa, Homo sapiens
MDFVAGAIGGVCGVAVGYPLDTVKVRIQTEPLYTGIWHCVRDTYHRERVWGFYRGLSLPVCTVSLVSS

SEQ ID NO: 128 - protein, 49 aa, Homo sapiens
MEKPLFPLVPLHWFGFGYTALVVSGGIVGYVKTGSVPSLAAGLLFGSLA

SEQ ID NO: 129 - protein, 15 aa, Homo sapiens
MGLLLPLALCILVLC

SEQ ID NO: 130 - protein, 26 aa, Homo sapiens
MGIQTSPVLLASLGVGLVTLLGLAVG

SEQ ID NO: 131 - protein, 25 aa, Homo sapiens
MSDLLLLGLIGGLTLLLLLTLLAFA

SEQ ID NO: 132 - protein, 29 aa, Homo sapiens
METVVIVAIGVLATIFLASFAALVLVCRQ

SEQ ID NO: 133 - protein, 35 aa, Homo sapiens
MAGSVECTWGWGHCAPSPLLLWTLLLFAAPFGLLG

SEQ ID NO: 134 - protein, 57 aa, Homo sapiens
MMPSRTNLATGIPSSKVKYSRLSSTDDGYIDLQFKKTPPKIPYKAIALATVLFLIGA

SEQ ID NO: 135 - protein, 36 aa, Homo sapiens
MALPQMCDGSHLASTLRYCMTVSGTVVLVAGTLCFA

SEQ ID NO: 136 - protein, 21 aa, Homo sapiens
MKKWFVAAGIGAGLLMLSSAA

SEQ ID NO: 137 - protein, 21 aa, Homo sapiens
MKQSTIALALLPLLFTPVTKA

SEQ ID NO: 138 - protein, 21 aa, Homo sapiens
MKKTAIAIAVALAGFATVAQA

SEQ ID NO: 139 - protein, 21 aa, Unknown
  Description of Unknown: Bacterial signal sequence
MKKLMLAIFFSVLSFPSFSQS

SEQ ID NO: 140 - protein, 23 aa, Unknown
  Description of Unknown: Bacterial signal sequence
MKKNIAFLLASMFVFSIATNAYA

SEQ ID NO: 141 - protein, 32 aa, Homo sapiens
MFAKRFKTSLLPLFAGFLLLFHLVLAGPAAAS

SEQ ID NO: 142 - protein, 19 aa, Homo sapiens
MRFPSIFTAVLFAASSALA

SEQ ID NO: 143 - protein, 19 aa, Homo sapiens
MRFPSIFTTVLFAASSALA

SEQ ID NO: 144 - protein, 19 aa, Homo sapiens
MRFPSIFTSVLFAASSALA

SEQ ID NO: 145 - protein, 19 aa, Homo sapiens
MRFPSIFTHVLFAASSALA

SEQ ID NO: 146 - protein, 19 aa, Homo sapiens
MRFPSIFTIVLFAASSALA

SEQ ID NO: 147 - protein, 19 aa, Homo sapiens
MRFPSIFTFVLFAASSALA

SEQ ID NO: 148 - protein, 19 aa, Homo sapiens
MRFPSIFTEVLFAASSALA

SEQ ID NO: 149 - protein, 19 aa, Homo sapiens
MRFPSIFTGVLFAASSALA

SEQ ID NO: 150 - protein, 21 aa, Homo sapiens
MRSSPLLRSAVVAALPVLALA

SEQ ID NO: 151 - protein, 22 aa, Homo sapiens
MGAAAVRWHLCVLLALGTRGRL

SEQ ID NO: 152 - protein, 17 aa, Artificial Sequence
  Description of Artificial Sequence: Synthetic signal sequence
MRSSLVLFFVSAWTALA

SEQ ID NO: 153 - protein, 32 aa, Homo sapiens
MLRGPGPGRLLLLAVLCLGTSVRCTETGKSKR

SEQ ID NO: 154 - protein, 26 aa, Homo sapiens
MLRGPGPGLLLLAVQCLGTAVPSTGA

SEQ ID NO: 155 - protein, 31 aa, Homo sapiens
MRRGALTGLLLVLCLSVVLRAAPSATSKKRR

SEQ ID NO: 156 - DNA, 4585 bp, Homo sapiens
ctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataa

SEQ ID NO: 157 - DNA, 3681 bp, Homo sapiens
cgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttgcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaata

SEQ ID NO: 158 - DNA, 2555 bp, Homo sapiens
atgttgtcaagactttttcgaatgcatggcctctttgtggcctcccatccctgggaagtcatagtggggacagtgacactgaccatctgcatgatgtccatgaacatgtttactgaaggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaatacc

SEQ ID NO: 159 - DNA, 268 bp, Homo sapiens
gagatcccgccactgcactccagcctgggcgacagagcgagactccgtctcaaaaaaaaaaaaaaaaaaaaattaatttttattgcagcattgcataaatactgtcaacttaatttgcaggagctatcctgtagcctgcttgtgacatttgcaactgctgatgaaggtggacgattgaattctatggcatgatccaaggattctgtagctacaatgttgtcaagactttttcgaatgcatggcctctttgtggcctcccatccctggg

SEQ ID NO: 160 - DNA, 527 bp, Homo sapiens
agaacagttaatttctgcagtaggaggaggtcgatgtactccattcttaagtagtcgtttgaaatatttcaggatttgaggatattccttcttagacatggtcctgcagagtcgtaggaagcatttgtttctgggctatactaaatgtgcatgatttcggcgtcccacaaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcatt

SEQ ID NO: 161 - DNA, 3395 bp, Homo sapiens
ctttctttaatccagtagacaatgagaaacgctgatttgggtctatggcataataggaagtagtatgccacatactgcatgtgggagttctgcaggacagattgggaagtgcatgcgtgtaagactgggaagaccagttaggagaggctattgcactgttttaagtaagacataataaagccctgcaccaggcggagagcagaaggaacgcacagaagacgcaggagaggcacatttcagagagaatccagtatgcaatggatgtcgcacacaagagagagagacgcaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatg

SEQ ID NO: 162 - DNA, 3394 bp, Homo sapiens
ctttctttaatccagtagacaatgagaaacgctgatttgggtctatggcataataggaagtagtatgccacatactgcatgtgggagttctgcaggacagattgggaagtgcatgcgtgtaagactgggaagaccagttaggagaggctattgcactgttttaagtaagacataataaagccctgcaccaggcggagagcagaaggaacgcacagaagacgcaggagaggcacatttcagagagaatccagtatgcaatggatgtcgcacacaagagagagagacgcaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaagaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatg

SEQ ID NO: 163 - DNA, 7241 bp, Homo sapiens
gcggcgccgggggcggggggcggcgggcgacggggcgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctggaagccgagcgcatgctgggagcggtactgtcagaagtgagcccagttagtaccccgctggctcactgcacgagagagtcctgccccgagccctaggtggggccaggaggtgccttggagaagccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtggtattttgaggtgaaagagtttgttcattttgaagatatttctgtctctctctcgacctgatgtgtagacgctcacttccagtagcagaaccaccttagttgtgtcttacagattctgaacaaatcggtttctgataagccatgtgttccaaagaatgtctgaataagaccgctctttatttaaatgctaagaggatgtcactactgcaatccatctgtggccgattttttccaagagccaatttccttgttttggttgcaagaacctggctctgcctgcatgtcagctctctgccctccctgctgccgtggctttcaagcgcttggcagaatcttgtacttcgtgtccacaatggtactgaatttgcatctgcacagtcagcagagataacaagtgttgaactgaccttgccacatgcttagtgagtgatttgtaattaagtttatagactcagaaggtatattaggacatttggaatcagtagcagagcaaagcctctttgaaaaaaaccacgtagctgattgggttttacaagagtgcatttgtctcccccttccacccgtggggccccaccttcaggtcttagtggttcacaagagcccagcagccaggctggctttttcattgtagggcgtggttgtcccagctggtgtagatttcaggccgccccccccaactccctgcccacagtgttgcagattgcctggctggcagcaagtccagaccacccaaatttggttggattcttcatttctccactgtagttggggtccattgattgtgcaggggaacgtgcaggaggtttttctaggcaccgtgttcagtgctgcttcactctaccagagattatggccaaattgcacggaatttggtttcttgccctctgaagcctgagggcccccccttgcctggctggttgacagacccggggtggtcactgctgagacttcagagatcgcagctgctgtgagaatacggtgaaggtactttgttctggaagatgttgtcatacacttttccccagttattttcaaacttgacatgagcctatgttgactcactgggtgggggtcccttcttacgcagcacacgtggcaagtgcctgaatcggggctggaggcacttcagagcctctgaggggccaccacttctggcccaaaattgcagggttgtagatgaggctgcctgtggagaactggtgtgaggaggaagctgtttccaacaaagagcactttcatctgttgagatggctgtggtgagcaactgaacgagcctacgtgtgtacctgaattttccccgtaactcatttcttccatatgaagaaacaccaaactatgtacagagaactttttacaaaaggcagaccttttttaagctgtgtaacccacatagcctaaccacctggcagaatgactacgaataggggtcattgtgctggtaaaagcctctattacgactgtaagtaagttggatgttggcaaaattaaattgttacagtatttagagctgctgtagctgttccttcacaacataaaataggataaatgactagtacgtctttcaggtgggtggcaagcagaacatgcgtaatattctctacctggtctgtagctgtaactgtgatgtacagacaaagcaaaaattaaaagaacttatgaaaacaaatgcaatgatactaggatatacacttttgtatttttattcttatataaggttatttgctggctattgttggcctctagttcagtctgtgttatttaaattctaatatatgaattatttgaattgaattcatgttcggggccacgttgttgtatgtattgatgtacagccttgaatgtgaataattattgtaaactatattttacaactttttttctggctttattatataaattttctattgggtcagtgatttaatcatataatttaatgaatctgtttatcctttttttttttccaaatacttgtgctttaggtgtagttaccagatgatgaattttcctcgtatggtcagtagtcttgtaataaaaagcatgtagagtgta

SEQ ID NO: 164 - DNA, 1819 bp, Homo sapiens
ccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaaggtgtttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttattt

SEQ ID NO: 165 - DNA, 1714 bp, Homo sapiens
cgggcgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttattt

SEQ ID NO: 166 - DNA, 4728 bp, Homo sapiens
cgcaggatgagggcggccattgctggggctccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgaccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctggaagccgagcgcatgctgggagcggtactgtcagaagtgagcccagttagtaccccgctggctcactgcacgagagagtcctgccccgagccctaggtggggccaggaggtgccttggagaagccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaa

SEQ ID NO: 167 - DNA, 10143 bp, Homo sapiens
atggtcggccgggcggtgtgttgtcatccgcggagcgacgaccggaggctgcggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgatgactttctggctgatcaagctgcatgttatgttcaggcaatacagtggattttgcactattactatcatggagttcagtcctggagctggtattatccttatcattatgcacctttcctgtctgatatacacaacatcagtacactcaaaatccattttgaactaggaaaaccttttaagccatttgaacagcttcttgctgtacttccagcagccagcaaaaatttacttcctgcatgctaccagcatttgatgaccaatgaagactcaccaattatagaatattacccacctgattttaaaactgacctaaatgggaaacaacaggaatgggaagctgtggtgttaatcccttttattgatgagaagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactggctgggatcactatggaagcaactatgcattgggggcagctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaattagccgggcgtgatggcacatgcctttagtcccagctactcgggaggctgaggcatgagaatcatttgaacccgcgaggcagagtctgcagtgagccgagattgcaccactgcactccagcctggagagcagagcaagactctgtctcaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtatatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgattttataa

SEQ ID NO: 168 - DNA, 5383 bp, Homo sapiens
cgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgatgactttctggctgatcaagctgcatgttatgttcaggcaatacagtggattttgcactattactatcatggagttcagtcctggagctggtattatccttatcattatgcacctttcctgtctgatatacacaacatcagtacactcaaaatccattttgaactaggaaaaccttttaagccatttgaacagcttcttgctgtacttccagcagccagcaaaaatttacttcctgcatgctaccagcatttgatgaccaatgaagactcaccaattatagaatattacccacctgattttaaaactgacctaaatgggaaacaacaggaatgggaagctgtggtgttaatcccttttattgatgagaagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaa

SEQ ID NO: 169 - DNA, 2075 bp, Homo sapiens
ggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtcagcaaaggaggcagaagacaaaattaaaaaggcaatagagaagggagaaactcttcctacagaggccagatttgattccaactgtatcacaccaggaactgaatttatggccaggttacatgaacatctgaagtattttgtaaatatgaaaatttccacagacaagtcatggcaaggagttaccatctacttctcaggccatgagactcctggagaaggagagcataaaatcatggaatttatcagatccgagaaagcaaagccagatcatgatccaaacaccagacactgtctttatggtttagatgctgacttgattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgagtacgtttttgccaatgcttttattttaaaatagaaaaaattagattttgcagttattcagaaaatatgattttgatgaagtagtgggagaaaaaggattttttggtttcatgaattattgtgtatgtttcaactagtctggttttggagaagatggtattaattctgacttgtattatattcctgtgataaaaattgctgaagagaaaatgatccttatgtataaggatttttgttacaaagttgtttataatagtaaaaaaattagaaataatctaaatgtccaataagaaggttcatcataattggccactgcttcttcattacagtcaccatctctgtcacctcttccatctccggaatctgcagaactgctaaactggtacttgcagaaagttcataacaatttggaaggatgcttatagtacattattaagtacaaattgtaaaggcaagacatgaaatcatacatacagtatgctctcattaaccttaaaaaaacctagatatagataaaagactgaaacactaaaaatgtaaaagtgatggctataagatgataaaaatgctgttcttcattgtccagattttcactcctgaggaaatagttcttttataataaaaaagcaatatttttcatattaaaaaactacctcccagaaa

SEQ ID NO: 170 - DNA, 1180 bp, Homo sapiens
gcggcggagccccggcggggcgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttagattatgcttggattaacaagtcatgaggcacatttttctctcttaagagaagaagttcgatttggtggcaaaaaaacacaacgggtatgtgctccagaagaaactacatttcaccttctacacttgtctttaatgagagagtatattgactatgagttttcagtattaaaagaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggttatattaatgaaagtgggcacctcaacttacctcgatttgagaaataccttgtgaaactatcagattttgatcgggagcacttcagtgaagtttttgtggacctaaaatggtttgaaagcaaagttggtaacaagtacctcaatgaagcagcaggtgtcgcagcagaagaagccaggaactacaaggaaaagaaaaagttaaagggccaggaaaattctctgtgttggactgctttagacaaaaatgaaggcgaaatgataacttctaaggataatttagaagatgagactgaagatgatgacctatttgaaactgagtttagacaatataaaagaacatattacatgacgaagatgggggttgacgtagtatctgagtacgtttttgccaatgcttttattttaaaatagaaaaaattagattttgcagttattcagaaaatatgattttgatgaagtagt

SEQ ID NO: 171 - DNA, 5600 bp, Homo sapiens
gaccaatgaagactcaccaattatagaatattacccacctgattttaaaactgacctaaatgggaaacaacaggaatgggaagctgtggtgttaatcccttttattgatgagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaa

SEQ ID NO: 172 - DNA, 1655 bp, Homo sapiens
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaa

SEQ ID NO: 173 - DNA, 2191 bp, Homo sapiens
ggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgctctgtcaggtcatcaccacttttatgacctttctcggaccccataggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaa

SEQ ID NO: 174 - DNA, 2220 bp, Homo sapiens
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaa

SEQ ID NO: 175 - DNA, 1815 bp, Homo sapiens
ccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaagga

SEQ ID NO: 176 - DNA, 1084 bp, Homo sapiens
ggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggaaactttttccggagcctgtggggaccttatgctggctgggcccaagcggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattga

SEQ ID NO: 177 - DNA, 1744 bp, Homo sapiens
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggaagcaggtgaggaggggacagggcagagaaactcccggttcagggagggaaggggagcaggctgcccccaagccctcccacgcaga

SEQ ID NO: 178 - DNA, 1950 bp, Homo sapiens
ctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagagg

SEQ ID NO: 179 - DNA, 1069 bp, Homo sapiens
cgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgc

SEQ ID NO: 180 - DNA, 1948 bp, Homo sapiens
cggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatc

SEQ ID NO: 181 - DNA, 9731 bp, Homo sapiens
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgt

SEQ ID NO: 182 - DNA, 9962 bp, Homo sapiens
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagagtta

SEQ ID NO: 183 - DNA, 9624 bp, Homo sapiens
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaa

SEQ ID NO: 184 - DNA, 1803 bp, Homo sapiens
agaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactg

SEQ ID NO: 185 - DNA, 662 bp, Homo sapiens
cggcctggtgctgcacgcctgtcagccatcgcccgagccgccggcgtctcctcccgcccagcagttcctccacgcaggggctccggaatcgcccgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 186 - DNA, 9554 bp, Homo sapiens
cggcctggtgctgcacgcctgtcagccatcgcccgagccgccggcgtctcctcccgcccagcagttcctccacgcaggggctccggaatcgcccgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaa

SEQ ID NO: 187 - DNA, 1064 bp, Homo sapiens
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 188 - DNA, 1064 bp, Homo sapiens; identical to SEQ ID NO: 187

SEQ ID NO: 189 - DNA, 9836 bp, Homo sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgt

SEQ ID NO: 190 - DNA, 1627 bp, Homo sapiens
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctagggtcttgctatgtcacccagcctggagtggaattgtgtgatcaagactcactgaagcctccaactcctgggctcaagcaatcctcccacctcagccacccaagtagctgggactacaggctggagtgcaatggcatgatcttggctcactgcaacctccgcctcccggattcaacggattctcctgcctcagcctcctgagtagctgggattataggtgcctgccacaacacccaggaccagacttatgaagtggccttcctgaggagattttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcagctggtcagattctccgaagaaggatcctctaggctgggcacggtggctcacacctataatcccagcactttgggaggccgaggcaggtggatcacgaggtcaggagttcgaggccagcctggccaatatggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 191 - DNA, 10657 bp, Homo sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctagggtcttgctatgtcacccagcctggagtggaattgtgtgatcaagactcactgaagcctccaactcctgggctcaagcaatcctcccacctcagccacccaagtagctgggactacaggctggagtgcaatggcatgatcttggctcactgcaacctccgcctcccggattcaacggattctcctgcctcagcctcctgagtagctgggattataggtgcctgccacaacacccaggaccagacttatgaagtggccttcctgaggagattttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcagctggtcagattctccgaagaaggatcctctaggctgggcacggtggctcacacctataatcccagcactttgggaggccgaggcaggtggatcacgaggtcaggagttcgaggccagcctggccaatatggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgt

SEQ ID NO: 192 - DNA, 1380 bp, Homo sapiens
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacag

SEQ ID NO: 193 - DNA, 341 bp, Homo sapiens
aggcactgactttcttgatgaattctgtccatctgtaaagcagctatatatcccactggaggctttgcctctcagagacaacgtgaagacggataagcaggcatcaggagcagagtggcctctcaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggct

SEQ ID NO: 194 - DNA, 3779 bp, Homo sapiens
aggaattcccaatgagaggcgatggggggaagtttgggcaactcggcctggccaatggagagcctcgggagggctctgccccttccccccgcccccgcccgcctcggctcccgcagcgctagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaa

SEQ ID NO: 195 - DNA, 3464 bp, Homo sapiens
cgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttg

SEQ ID NO: 196 - DNA, 3043 bp, Homo sapiens
aggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattatttt

SEQ ID NO: 197 - DNA, 4963 bp, Homo sapiens
gcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggattcctgcagcatcatctttttttatttctcctgtgtctgtcctccaccttctaggagagccagggcagagctagcactgtcttaagctgtcaacgtggactagctcgtgtcatctgctcgagaagggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccactaaggaagagaaggaagacagtggcttgaggcagggagctcgcaggacagagcctgagccaccctgtccctcccacctggctcacctgtctgtgggtcaggcagatgaccccctcacccccatccaggtgctggctgcagtggcctgtgcagagaggggcagggtgagtgcccaccagtccccgtaccccttccccccatgccccaccatgccggggtggtactcacagaagatgcaggtgaggtgggccacacaggacacgaaccgctcgaagtccacacgcagacggctatcccggtagcggctggtgagggtctgggtcagctggttgttcaggtggaagcctagggggaggctgcttctgagcccagtggcccacagggaacccaccttggcattgcatccccaccccacctcctcagggaggacatgaatgccacagggtgtcacaccccaactctgccccatcccggcagggtgagtacaggctgatcccttcaatcctctgggcctgtttcctcatccatcaaacggactaagacagccccgaccccatagggtgtgtgaagacagaacgctcaggacagcgtctgacacgtgactcgatgtgtgggtactgttactccttaaatcctgtggggctttctccttgccagtgggcactggaggatatttctgtgcagcaaaaaatatagtcaatccca

SEQ ID NO: 198 - DNA, 2102 bp, Homo sapiens
gcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctg

SEQ ID NO: 199 - DNA, 1625 bp, Homo sapiens
agaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggttcacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 200 - DNA, 2171 bp, Homo sapiens
agaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaacc

SEQ ID NO: 201 - DNA, 3084 bp, Homo sapiens
aatagccctgccgcagcccatccagctggctcagagccgttccccatgcccgggtgtctccatcaccccagaaaacatgcaaaacagctcggcgcctctgtgttcctgactgtgaaatggggatagggctctgtgtcccaccagcgaggtgctggaagaggctcacgaggagctccagagggcagcctctagagcggcccgcggccactattattatcggcctttctattgtggagaggagtaaacagactcagagaggtcccgtggatttctcaaggtcacacagcgccccagcagcggagcaggaatgcaaacccaggatctccgccgcgagatccaccccggcgcccccgagtcccgcagttcccggcttcaggacaaccccttgccagaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccggctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgactgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagctgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcagaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtc

SEQ ID NO: 202 - DNA, 704 bp, Homo sapiens
gcgaagccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaagaaaacgaaagctcagagagggaaagggactggcccaggatgcacagcaagtcagtggctgagctgagctgagacttgaatccagaaatacaaggctctgagacctaccctgactgaggagacaggactgtgccctacatcccccagagccagtcgtagggtttgagtgctgtcctctgcccctagaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgctt

SEQ ID NO: 203 - DNA, 2939 bp, Homo sapiens
agtgcgaattcgatctggggctgggctgggccctacttaatggggcccgggtgtccgagagcgtgccgagcggagcgaagccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaaaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccggctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgactgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagctgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcagaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtctct

SEQ ID NO: 204 - DNA, 4176 bp, Homo sapiens
gttgtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcataa

SEQ ID NO: 205 - DNA, 4079 bp, Homo sapiens
gttgtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcataa

SEQ ID NO: 206 - DNA, 801 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 207 - DNA, 1919 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 208 - DNA, 2109 bp, Homo sapiens
gtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccagatactgaattcattacttaaaaccacccagaagagaaacctccaggctcagatagcttcactggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactg

SEQ ID NO: 209 - DNA, 1335 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtgtaagtgattcaggccaatcattgaacatatacatgaattaagtttgttttgtaatgatttttcctaagacatttgattattcaaactaagatcttagttttgtatgtgtgtgcatgcttcgaattttggaaaaagtacttgcgtagtcttctttaatataaatattaactaacagagtgggagataaatacaactaaaaacaaatatagaatgtgaatttaagatagtcttattttcatgctatttcacacaaaatataaaattactgcatcaccagattccatttctttcagttcttactggtagctcccaagagctctctgatgacagtttttctcattttacaaattggagattgtcctaagtaaatccataacttttctcttcttttcaatactgctacacaggttatgcatttaagatgcaattaaaaataattaaatttt

SEQ ID NO: 210 - DNA, 2113 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatacaaatatttcttcagctctattccataaggcagtgggcacccagatgtttccatatgcatggttgtgccttcttttgacctattgcaggaaaatgaataatttttcttttttccacccagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 211 - DNA, 1966 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtctcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatacaaatatttcttcagctctattccataaggcagtgggcacccagatgtttccatatgcatggttgtgccttcttttgacctattgcagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 212 - DNA, 1919 bp, Homo sapiens; identical to SEQ ID NO: 207

SEQ ID NO: 213 - DNA, 1989 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctct

SEQ ID NO: 214 - DNA, 2081 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatacaaatatttcttcagctctattccataaggcagtgggcacccagatgtttccatatgcatggttgtgccttcttttgacctattgcagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 215 - DNA, 1966 bp, Homo sapiens; identical to SEQ ID NO: 211

SEQ ID NO: 216 - DNA, 2081 bp, Homo sapiens; identical to SEQ ID NO: 214

SEQ ID NO: 217 - DNA, 3505 bp, Homo sapiens
aagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaatt

SEQ ID NO: 218 - DNA, 5333 bp, Homo sapiens
gcgattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatc

SEQ ID NO: 219 - DNA, 5032 bp, Homo sapiens
gtctgcagccagcgattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatc

SEQ ID NO: 220 - DNA, 5225 bp, Homo sapiens
ctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttgcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatc

SEQ ID NO: 221 - DNA, 506 bp, Homo sapiens
gtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaa

SEQ ID NO: 222 - DNA, 802 bp, Homo sapiens
tccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactg

SEQ ID NO: 223 - DNA, 573 bp, Homo sapiens
acgcggttcctttttgcgagctttccgagtgccaggcgccggccggctgcgaagacgcggtgggccgcccctccgattgaaatcacagaagatattcgtgttcttcttaagagaaaaagaggacatttcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatga

SEQ ID NO: 224 - DNA, 587 bp, Homo sapiens
actctagagcattaaaagtgtcttcaacatggcagctgaggtgctttctttgctgggaaaagctgcaaagagactggcagaatggcgacttcaggagttaatacctctccagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaat

SEQ ID NO: 225 - DNA, 637 bp, Homo sapiens
tccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactat

SEQ ID NO: 226 - DNA, 4349 bp, Homo sapiens
acctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaaaattcactatctacaaacctagaatatttaaaatacaaagattgcctgttttcaaacactattgaataagagggtgagatatttcttaacaacaacaacaacaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaa

SEQ ID NO: 227 - DNA, 1881 bp, Homo sapiens
cgccacctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatacacacagatagagctaattgacagagttgatgacatctatcggaacacttcatgggataatgcaggttttaaaggctatggaatacagatagagcagttattatttgaataggtaacatgtacacagtacaaaagccagtgaaaagtaagtctctgcagcctgtttattgtcaaaccagttcctttccccaaagacattcatgtcactagtttcatatgtatctttctagagatgtcgtatgcaggtatagtgtatgtatatgtctgtatttgacacaacggtgctatgcagtacacttttacaccttgctttttcatttcacagtatgttggagagtacttcatgttcatgcatgtaaagctgcttcacttgttttattataaatagctgcatcatgtttgagtttcagggaacctgtaaattttctttttgctttaggcatttggaaccagtcgaagaaacaggaataatataggagattaaaacattaacttctttacatctgatgaaggatggattggagggtgtggtttagatgtgtatcatggtgggcttctaagtagttctatcccagatttgaccttgaccagccaccatcaaaactgcagagtccaccccagtaaacttaccacacagtggcagaggagaccagaatgggccttctctgcaggcaggcaggcaggcaggcaggcagagagactcacagaaactctgagctgagcatggtttccttctttatctcacacttactaatgggagcctttgttacttttttttttcttctttgcaggtttaatatgaatttgtctgaaatgcctgtataaggagaagactctattcttagccttttattcctttgatgcacaaagagatgtatattttattattctttcctgagttgtcgactgtagtcgtaataaatattttaggctcctgt

SEQ ID NO: 228 - DNA, 6327 bp, Homo sapiens
ggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaagggtcctagtgccaccaatctcataataggctccatcgctggtgccatcctggtagcagctattgtccttgggggcacaggctggggatttaaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttggaaaaaattaagctttccattttatttgtatttgttagtgtcaatatttcatccatgctcattttcctgcctcaaaatatatatggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgcccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgta

SEQ ID NO: 229 - DNA, 2714 bp, Homo sapiens
atgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaaggtgaatatggccacaagcaggctaataggggccgtggccggcaccattctggccctgggggtgatttttggaggcacagggtggggaatagaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacggg

SEQ ID NO: 230 - DNA, 2988 bp, Homo sapiens
tagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaaggaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattc

SEQ ID NO: 231 - DNA, 2486 bp, Homo sapiens
acacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccgcagctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaaggatgaaggacccaaggcctgttttctgaagcggacgaagtgcaaatcatatccaaagcatagaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacggggga

SEQ ID NO: 232 - DNA, 460 bp, Homo sapiens
tacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaaggaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaa

SEQ ID NO: 233 - DNA, 10701 bp, Homo sapiens
ggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgca

SEQ ID NO: 234 - DNA, 11025 bp, Homo sapiens
acaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgca

SEQ ID NO: 235 - DNA, 10619 bp, Homo sapiens
gaatggaggtgctgccggactcggaaatggggacacatgcattggtggccaaaagagagaggagacaaaaccgctgcagatggctgatgtgaatctagtggaaagagctactggggatgagagaaagaggaggaggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttg

SEQ ID NO: 236 - DNA, 7406 bp, Homo sapiens
actggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagatagaaaagatgaggatgtttgaatgctgatgggaaggagccagtagagaagagagttgaagatccctaagatcaaagagaaatggagagagaaaggatccagagcacatctaaagggatggaccttagataggaggaggggaactctgatgtcacagcaaaaggtggcgatggatatatacgcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaat

SEQ ID NO: 237 - DNA, 524 bp, Homo sapiens
gcattgtagtcttcccacctcccacaagatggcggagggcaagtagcaagggggcggggtgtggccgccggaagcctagccgctgctcgggggggacctgcgggctcaggcccgggagctgcggaccgaggttggctcgatgctgttcccaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcattt

SEQ ID NO: 238 - DNA, 4061 bp, Homo sapiens
cttttcctccctggcgacaaggacacatgcattggtggccaaaagagagaggagacaaaaccgctgcagatggctgatgtgaatctagtggaaagagctactggggatgagagaaagaggaggaggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagc

SEQ ID NO: 239 - DNA, 6515 bp, Homo sapiens
cccgactgaaggtagagaaggctacgtggtgggggagggtggggggagggtcgcggccgcactggcagtctccgggtgtccggccgtgtcccgaggaagtgcaagacccggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 240 - DNA, 6620 bp, Homo sapiens
gaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 241 - DNA, 3585 bp, Homo sapiens
gggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagta

SEQ ID NO: 242 - DNA, 1583 bp, Homo sapiens
cggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaa

SEQ ID NO: 243 - DNA, 3869 bp, Homo sapiens
cagcagcagctccagctcggtgcagaagcccagcagccggcgtgccgccgcccggccactccagcgccttcttccccgccttgcgctcctgccccaactcgcgctgtcgtcggaccccggcccatccagcagcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtcccggagctccgcacagtgtgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttaaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtcctcttgtctgttatctgagttttcaaaagctttaagactctgggaacatctgattttatggattttttaaaaataaaaaatgtacatt

SEQ ID NO: 244 - DNA, 2034 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcagg

SEQ ID NO: 245 - DNA, 1974 bp, Homo sapiens
aaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 246 - DNA, 1885 bp, Homo sapiens
atccgcgctgtcccttccgcgggctcttgctgttcttcgccaggaggctttgcactccgggccgcatgggtcctggataaggacctcaagaggttgtagtggcgccccttcgctccggcgtactgtctgaaccctgtgcccaaagagggctgtggcagttcctgcaccaaccgcctggagcccatacctaagccctctgggcacgagggacctcctctcccccgctcccccctccccccatcccaactccagccccaaaggaagcaatgcgcgcgtccgagagcaggagcgcgcgtggctgaggaaagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctga

SEQ ID NO: 247 - DNA, 867 bp, Homo sapiens
ggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcaccgtccggcggcgagctctggctttgcaagggcccctccttctgggggcttcgcttccttagccttgctcaggtgcaagtgccccagggggcggggtgcagaagaatccgagtgtttgccaggcttaaggagagga

SEQ ID NO: 248 - DNA, 1889 bp, Homo sapiens
tcttggtgacactggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgg

SEQ ID NO: 249 - DNA, 715 bp, Homo sapiens
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 250 - DNA, 1250 bp, Homo sapiens
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 251 - DNA, 1369 bp, Homo sapiens
gccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 252 - DNA, 1492 bp, Homo sapiens
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 253 - DNA, 716 bp, Homo sapiens
ggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 254 - DNA, 665 bp, Homo sapiens
atggcagccggaacagcagttggagcctgggtgctggtcctcagtctgtggggggcagtagtaggtgctcaaaacatcacagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 255 - DNA, 1490 bp, Homo sapiens
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatctt

SEQ ID NO: 256 - DNA, 387 bp, Homo sapiens
atggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 257 - DNA, 493 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 258 - DNA, 1371 bp, Homo sapiens
atggcagccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 259 - DNA, 864 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatccca

SEQ ID NO: 260 - DNA, 1249 bp, Homo sapiens
aggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatccca

SEQ ID NO: 261 - DNA, 9390 bp, Homo sapiens
ggcaatttcttttcctttctaactgtggcccgcgttgtgctgttgctgggcaggcgttgggcgccggcggtcttcgagcgtgggggcccgctggctttcccttctcagaaactgcgccgggggcgctcgcttgccccggattcggacgcggcgctccccgggctcgtctgaagtgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatc

SEQ ID NO: 262 - DNA, 1538 bp, Homo sapiens
gagcttgccagccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagctccg

SEQ ID NO: 263 - DNA, 9285 bp, Homo sapiens
gagcttgccagccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcattggggttgaatcca

SEQ ID NO: 264 - DNA, 1486 bp, Homo sapiens
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaa

SEQ ID NO: 265 - DNA, 9279 bp, Homo sapiens
gagcttgccagccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccccatctgcacctccaagtgctccacagtcccttccagaaccagtggcatcagcacattccagcagtgcagagtcagaaagcaccagtgactcagacagttcctcagactcagagagcgagagcagttcaagacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcattggggttgaatcca

SEQ ID NO: 266 - DNA, 3164 bp, Homo sapiens
gtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccaga

SEQ ID NO: 267 - DNA, 2712 bp, Homo sapiens
ttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttg

SEQ ID NO: 268 - DNA, 1024 bp, Homo sapiens
agctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagca

SEQ ID NO: 269 - DNA, 18787 bp, Homo sapiens
acaagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaacct

SEQ ID NO: 270 - DNA, 568 bp, Homo sapiens
agctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcat

SEQ ID NO: 271 - DNA, 580 bp, Homo sapiens
gagctggcgacccgactccatggtccagcacatggcacagagactggggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcgggg

SEQ ID NO: 272 - DNA, 579 bp, Homo sapiens
aagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagtggaaggacgtgagacgaattaccccacccccaacacctcacctggcagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagct

SEQ ID NO: 273 - DNA, 584 bp, Homo sapiens
gggcttggcgtgggaggagggctaagctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagca

SEQ ID NO: 274 - DNA, 3678 bp, Homo sapiens
ggagtccagtgctggaggggcagggacggcggcggcgcagctcggaacccgccagggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggcccccatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgagtgaga

SEQ ID NO: 275 - DNA, 663 bp, Homo sapiens
gagcgacagagcgagactctgtctcaaaaacaaataaaggaaaaagaaaaaaatgagaagcgcgtgttcccgactccggtgctttttcgcaaggtcgtgctactgcgccttctgaactacgagtcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaa

SEQ ID NO: 276 - DNA, 638 bp, Homo sapiens
gaggagtccagtgctggaggggcagggacggcggcggcgcagctcggaacccgccagggtccagggtccaggttccagcgcccggcggcccagctctcaagcagatcaatgcaatgccacctggccgcttgctttgcccactgggcctacagccggaagcctgcccttcagccctcgggcctgatcccaggccgcctgcagcctgtaaccagacactgtttgcttccagcaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcg

SEQ ID NO: 277 - DNA, 589 bp, Homo sapiens
tgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggaggtaaatacaagtgaaaatgaaacatgaatttaaattgctgtttatgaccatattggaaaatcggatgtgcttactaaaaatacctccacttttctgccttttgtttattaaaagcactacttaaa

SEQ ID NO: 278 - DNA, 11145 bp, Homo sapiens
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccattatcataaaatcagatcgatatttatgtgccccaaacaaaactttaagagcagttacattctgtcccagtagcccttgtttcctttgagagtagcatgttgtgaggctatagagacttattctaccagtaaaacaggtcaatccttttacatgtttattatactaaaaattatgttcagggtatttactactttatttcaccagactcagtctcaagtgacttggctatctccaaatcagatctacccttagagaataaacatttttctaccgttattttttttcaagtctataatctgagccagtcccaaaggagtgatcaagtttcagaaatgctttcatcttcacaacattttatatatactattatatggggtgaat

SEQ ID NO: 279 - DNA, 11031 bp, Homo sapiens
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccattatcataaaatcagatcgatatttatgtgccccaaacaaaactttaagagcagttacattctgtcccagtagcccttgtttcctttgagagtagcatgttgtgaggctatagagacttattctaccagtaaaacaggtcaatccttttacatgtttattatactaaaaattatgttcagggtatttactactttatttcaccagactcagtctcaagtgacttggctatctccaaatcagatctacccttagagaataaacatttttctaccgttattttttttcaagtctataatctgagccagtcccaaaggagtgatcaagtttcagaaatgctttcatcttcacaacattttatatatactattatatggggtgaat

SEQ ID NO: 280 - DNA, 2737 bp, Homo sapiens
ataaactacaacagagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatg

SEQ ID NO: 281 - DNA, 4252 bp, Homo sapiens
ggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctat

SEQ ID NO: 282 - DNA, 692 bp, Homo sapiens
gccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacagttttgcatttgaataaaatgggtatgcttaaaagcataaaatatttctaattaaaacactgatgctgtcaaaattaaaatcaagaagcaaattgatgaaaaagatatacagcacatatgaataatgcccttaatttgtaaagagcttttatttcagaaaaattatgaatgtgaataaatccataaaagaagatatacaaaattccagagtatttttttaaaaagtatttacccacattaataataaaaggtgtataagtt

SEQ ID NO: 283 - DNA, 3776 bp, Homo sapiens
ggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgtccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccagg

SEQ ID NO: 284 - DNA, 2632 bp, Homo sapiens
tgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatc

SEQ ID NO: 285 - DNA, 6220 bp, Homo sapiens
gggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaa

SEQ ID NO: 286 - DNA, 1353 bp, Homo sapiens
atgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtaaagagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 287 - DNA, 3615 bp, Homo sapiens
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 288 - DNA, 3899 bp, Homo sapiens
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 289 - DNA, 1222 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 290 - DNA, 742 bp, Homo sapiens
tccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 291 - DNA, 4353 bp, Homo sapiens
gccctaagccatcagcaatccttagtataggggcacactcatgcattcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaa

SEQ ID NO: 292 - DNA, 3293 bp, Homo sapiens
acagtttcaaatttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagt

SEQ ID NO: 293 - DNA, 4311 bp, Homo sapiens
ttcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaa

SEQ ID NO: 294 - DNA, 1523 bp, Homo sapiens
cggctaagtttttgtatttttagtagagacggggtttcaccatgtttgccaggatggtctcgatctcttgacctcgtgatccacccgccttggcctcccaaagtgctgggattacaggcgtgagccactgcgcccggcggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttc

SEQ ID NO: 295 - DNA, 1526 bp, Homo sapiens
cggctaagtttttgtatttttagtagagacggggtttcaccatgtttgccaggatggtctcgatctcttgacctcgtgatccacccgccttggcctcccaaagtgctgggattacaggcgtgagccactgcgcccggcggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttc

SEQ ID NO: 296 - DNA, 5416 bp, Homo sapiens
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattctaaaacagaggtctgttttctttcctagtaagatatatttttatagaactagactacaatttaatttctggttgagaaaagccttctatttaagaaatttacaaagctatatgtctcaagattcacccttaaatttacttaaggaaaaaaataattgacactagtaagtttttttatgtcaatcagcaaactgaaaaaaaaaaaagggtttcaaagtgcaaaaacaaaatctgatgttcataatatatttaaatatttaccaaaaatttgagaacacagggctgggcgcagtggctcacacctataatcccagtacattggtaggcaaggtgggcagatcacctgaggtcaggagttcaagaccagcctggacaacatggtgaaaccctgtctctactaaataatacaaaaattagccaggcgtgctggcgggcacctgtaatcccagctactcgggaggctgaggcagggagaattgcttgcaccagggaggtagaggttgcagtgagccaagatcgcaccactgcactccagccggggcaacagagcaagactccatctcaaaaaaaaaaaaaaaaaaagaaagaaaagaaaatttgagaacacagctttatactcgggactacaaaaccataaactcctggagttttaactccttttgaaattttcatagtacaattaatactaatgaacatttgtgtaaagctttataatttaaaggcaatttctcatatattcttttctgaatcatttgcaaggaagttcagagtccagtctgtaactagcatctactatatgtctgtcttcaccttacagtgttctaccattattttttctttattccatttcaaaatctaatttattttaccccaacttctccccaccacttgacgtagttttagaacacacaggtgttgctacatatttggagtcaatgatggactctggcaaagtcaaggctctgttttatttccaccaaggtgcacttttccaacaactatttaactagttaagaacctccctatcttagaactgtatctactttatatttaagaaggttttatgaattcaacaacggtatcatggccttgtatcaagttgaaaaacaactgaaaataagaaaatttcacagcctcgaaagacaacaacaagtttctaggatatctcaatgacaagagtgatggatacttaggtagggaaacgctaatgcaggaaaaactggcaacaacacaatttatatcaattctctttgtaggcaggtgataaaaaattcaaggacaaatctcattatgtcattgtgcatcatatataatctcttatgagcgagaatggggggaatttgtgtttttactttacacttcaattccttacacggtatttcaaacaaacagttttgctgagaggagcttttgtctctccttaagaaaatgtttataaagctgaaaggaaatcaaacagtaatcttaaaaatgaaaacaaaacaacccaacaacctagataactacagtgatcagggagcacagttcaactccttgttatgttttagtcatatggcctactcaaacagctaaataacaacaccagtggcagataaaaatcaccatttatctttcagctattaatcttttgaatgaataaactgtgacaaacaaattaacatttttgaacatgaaaggcaacttctgcacaatcctgtatccaagcaaactttaaattatccacttaattattacttaatcttaaaaaaaattagaacccagaacttttcaatgaagcatttgaaagttgaagtggaatttaggaaagccataaaaatataaatactgttatcacagcaccagcaagccataatctttatacctatcagttctatttctattaacagtaaaaacattaagcaagatataagactacctgcccaagaattcagtcttttttcatttttgtttttctcagttctgaggatgttaatcgtcaaattttctttggactgcattcctcactactttttgcacaatggtctcacgttctcacatttgttctcgcgaataaattgataaaaggtgttaagttctgtgaatgtctttttaattatgggcataattgtgcttgactggataaaaacttaagtccacccttatgtttataataatttcttgagaacagcaaactgcatttaccatcgtaaaacaacatctgacttacgggagctgcagggaagtggtgagacagttcgaacggctcctcagaaatccagtgacccaattctaaagaccatagcacctgcaagtgacacaacaagcagatttattatacatttattagccttagcaggcaataaaccaagaatcactttgaagacacagcaaaaagtgatacactccgcagatctgaaatagatgtgttctcagacaacaaagtcccttcagaatcttcatgttgcataaatgttatgaatattaataaaaagttgattgagaaaaa

SEQ ID NO: 297 - DNA, 5244 bp, Homo sapiens
aaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattctaaaacagaggtctgttttctttcctagtaagatatatttttatagaactagactacaatttaatttctggttgagaaaagccttctatttaagaaatttacaaagctatatgtctcaagattcacccttaaatttacttaaggaaaaaaataattgacactagtaagtttttttatgtcaatcagcaaactgaaaaaaaaaaaagggtttcaaagtgcaaaaacaaaatctgatgttcataatatatttaaatatttaccaaaaatttgagaacacagggctgggcgcagtggctcacacctataatcccagtacattggtaggcaaggtgggcagatcacctgaggtcaggagttcaagaccagcctggacaacatggtgaaaccctgtctctactaaataatacaaaaattagccaggcgtgctggcgggcacctgtaatcccagctactcgggaggctgaggcagggagaattgcttgcaccagggaggtagaggttgcagtgagccaagatcgcaccactgcactccagccggggcaacagagcaagactccatctcaaaaaaaaaaaaaaaaaaagaaagaaaagaaaatttgagaacacagctttatactcgggactacaaaaccataaactcctggagttttaactccttttgaaattttcatagtacaattaatactaatgaacatttgtgtaaagctttataatttaaaggcaatttctcatatattcttttctgaatcatttgcaaggaagttcagagtccagtctgtaactagcatctactatatgtctgtcttcaccttacagtgttctaccattattttttctttattccatttcaaaatctaatttattttaccccaacttctccccaccacttgacgtagttttagaacacacaggtgttgctacatatttggagtcaatgatggactctggcaaagtcaaggctctgttttatttccaccaaggtgcacttttccaacaactatttaactagttaagaacctccctatcttagaactgtatctactttatatttaagaaggttttatgaattcaacaacggtatcatggccttgtatcaagttgaaaaacaactgaaaataagaaaatttcacagcctcgaaagacaacaacaagtttctaggatatctcaatgacaagagtgatggatacttaggtagggaaacgctaatgcaggaaaaactggcaacaacacaatttatatcaattctctttgtaggcaggtgataaaaaattcaaggacaaatctcattatgtcattgtgcatcatatataatctcttatgagcgagaatggggggaatttgtgtttttactttacacttcaattccttacacggtatttcaaacaaacagttttgctgagaggagcttttgtctctccttaagaaaatgtttataaagctgaaaggaaatcaaacagtaatcttaaaaatgaaaacaaaacaacccaacaacctagataactacagtgatcagggagcacagttcaactccttgttatgttttagtcatatggcctactcaaacagctaaataacaacaccagtggcagataaaaatcaccatttatctttcagctattaatcttttgaatgaataaactgtgacaaacaaattaacatttttgaacatgaaaggcaacttctgcacaatcctgtatccaagcaaactttaaattatccacttaattattacttaatcttaaaaaaaattagaacccagaacttttcaatgaagcatttgaaagttgaagtggaatttaggaaagccataaaaatataaatactgttatcacagcaccagcaagccataatctttatacctatcagttctatttctattaacagtaaaaacattaagcaagatataagactacctgcccaagaattcagtcttttttcatttttgtttttctcagttctgaggatgttaatcgtcaaattttctttggactgcattcctcactactttttgcacaatggtctcacgttctcacatttgttctcgcgaataaattgataaaaggtgttaagttctgtgaatgtctttttaattatgggcataattgtgcttgactggataaaaacttaagtccacccttatgtttataataatttcttgagaacagcaaactgcatttaccatcgtaaaacaacatctgacttacgggagctgcagggaagtggtgagacagttcgaacggctcctcagaaatccagtgacccaattctaaagaccatagcacctgcaagtgacacaacaagcagatttattatacatttattagccttagcaggcaataaaccaagaatcactttgaagacacagcaaaaagtgatacactccgcagatctgaaatagatgtgttctcagacaacaaagtcccttcagaatcttcatgttgcataaatgttatgaatatt

SEQ ID NO: 298 - DNA, 1466 bp, Homo sapiens
ccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaaggtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgagga

SEQ ID NO: 299 - DNA, 1903 bp, Homo sapiens
ataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactt

SEQ ID NO: 300 - DNA, 1789 bp, Homo sapiens
ataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactt

SEQ ID NO: 301 - DNA, 1719 bp, Homo sapiens
gaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgta

SEQ ID NO: 302 - DNA, 2699 bp, Homo sapiens
gtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtggctgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagtttgaaaccagcctggccaacttgatgaaaccccatctctacccattctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgc

SEQ ID NO: 303 - DNA, 670 bp, Homo sapiens
agattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttg

SEQ ID NO: 304 - DNA, 1778 bp, Homo sapiens
tagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacaga

SEQ ID NO: 305 - DNA, 854 bp, Homo sapiens
atgtcaaattacactgatgctgagtcaagcttctcaaagcaagagataatcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctcc

SEQ ID NO: 306 - DNA, 11218 bp, Homo sapiens
taccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggtatgaaaatgaaagtcttcagaatggaaggaagtcaactgaatttccaagaaaaatacgtgaacaggagccagcacgtcgtgtctcaagatctagcttctcttctgaccctgatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctt

SEQ ID NO: 307 - DNA, 11417 bp, Homo sapiens
taccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 308 - DNA, 12678 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 309 - DNA, 12490 bp, Homo sapiens
taccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctt

SEQ ID NO: 310 - DNA, 200 bp, Homo sapiens
atgtggcccacgagacgcctggttactatcaaaaggagcggggtcgacggtccccactttcccctgagcctcagcacctgcttgtttggaaggaggaaatgtgttcttcagtgcacagaatgcagcaaaacagccatctgataaatgctctgcaagccctcccttaagacggcagtgtattagagaaaatggaaacgtag

SEQ ID NO: 311 - DNA, 3245 bp, Homo sapiens
ctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctcacctttgaaaatgggactggtagaccaggcacagtggtgcacgcctgtaatcccagcactttgggaggctgagatgggtggatcacctgaggtcaggagttcgcaaccagcctaacatggtgagaccccgtctctactaaatacaaaaaaattaactgggcgtggtggcgcgtgcctgtaatccaagctacttaggaggctgagacaggagaatagcttgtacctgggaggcggaggttgcagtgggctgagatcatgcattgcactccagcctgggcaacaagagtgaaattcagtctccaaaaaaaaaaaaagaaaagaaaaagaatgggactggtaaatcctgttctgtgggatgccgtgggagggagagaggataatggattgaggaagacatccatatccccttatggaaaatacctctttggttttggggaaccactcctttctagggaatttggttagggctgactcatttcctggcttcaggggctaccctgggcccagatttccagggcccggattaccagtgaagcgtcaatccctggatttttattgaaaccattggagaagagccatctcaaataaatctgccaagtatcctagctctttgcaactcactgtgtagtttttgggcatttccttcctctttctcattctgtttccctgttggtaaaatggaatggtgaccaacaagtgacctatggttacctcatagatctgccacttgtctgagggagtcagaatgcacttgtctgttccctgtccaataaaaggcttcacatgc

SEQ ID NO: 312 - DNA, 1484 bp, Homo sapiens
ccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 313 - DNA, 1387 bp, Homo sapiens
cttctttgtgctcgggttaggaggagctaggctgccatcgggccggtgcagatacggggttgctcttttgctcataagaggggcttcgctggcagtctgaacggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 314 - DNA, 899 bp, Homo sapiens
cccacgtgggggctcagcgtgcacccttctttgtgctcgggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgccta

SEQ ID NO: 315 - DNA, 1433 bp, Homo sapiens
aggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcag

SEQ ID NO: 316 - DNA, 773 bp, Homo sapiens
aggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatg

SEQ ID NO: 317 - DNA, 566 bp, Homo sapiens
ttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaact

SEQ ID NO: 318 - DNA, 671 bp, Homo sapiens
cttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcatag

SEQ ID NO: 319 - DNA, 2248 bp, Homo sapiens
tcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 320 - DNA, 2260 bp, Homo sapiens
aatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttct

SEQ ID NO: 321 - DNA, 2248 bp, Homo sapiens
agcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 322 - DNA, 1200 bp, Homo sapiens
aggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 323 - DNA, 1925 bp, Homo sapiens
gcccaggctggagtgcaatggtgtgatctctgctcaccacaacctccgcctcccaggttcaagcgattctcctgtctcagcctctggagtagctgggattacaggcatgcaccaccacacctggctaattttgtatttttggtagagacagggtttctccatgttggtcaggctggtcttgaactcccaacctcaggtgatccacccacctcggccacccaaagtgctgggattataggtgtgagtcactgcacctggccaacagcaatactttctttcctttcttttcctctaccctctatgccaggactccttagaaataaaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 324 - DNA, 1925 bp, Homo sapiens; identical to SEQ ID NO: 323

SEQ ID NO: 325 - DNA, 2105 bp, Homo sapiens
tcgccgaaatgttccggtgtggaggcctggcggcgggtgctttgaagcagaagctggtgcccttggtgcggaccgtgtgcgtccgaagcccgaggcagaggaaccggctcccaggcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 326 - DNA, 4539 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 327 - DNA, 6929 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 328 - DNA, 7055 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 329 - DNA, 7022 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 330 - DNA, 3744 bp, Homo sapiens
ggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcatta

SEQ ID NO: 331 - DNA, 3492 bp, Homo sapiens
atggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataa

SEQ ID NO: 332 - DNA, 6581 bp, Homo sapiens
agggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 333 - DNA, 5444 bp, Homo sapiens
acttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgg

SEQ ID NO: 334 - DNA, 1143 bp, Homo sapiens
tagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaa

SEQ ID NO: 335 - DNA, 2504 bp, Homo sapiens
cctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 336 - DNA, 2178 bp, Homo sapiens
gctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagc

SEQ ID NO: 337 - DNA, 3938 bp, Homo sapiens
ggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagagga

SEQ ID NO: 338 - DNA, 3579 bp, Homo sapiens
atgagccggggcgcgggcgcgcttcagcgccggacaacgacctacctcatctcgctgaccctggttaagctcgagtcggtgcctccgccgccgccttctccgtctgcggccgcggccggcgccgccggtgccagaggctccgagactggggatcctggcagcccccgaggcgcggaggagccgggcaagaagcggcacgaacgtctcttccaccggcaggatgcgctgtggatcagcacgagcagcgcgggcaccgggggcgcggagcccccagccctgtccccggctccggccagtccggcccgcccagtctcccccgctcccggccgccgcctctccctctgggccgtccctccgggacccccgctctccgggggactgagccccgaccccaagcctgggggcgcccccacctcctcccggcgccccctgctcagcagcccgagctggggcggcccggagcccgaaggccgggcgggcggcggcatccctggctcatcctctccgcaccctggcaccggcagccggaggctcaaggtggcgcctcctccgccggctcccaagccttgcaagaccgtgaccacgagtggagccaaagccggcgggggcaagggcgcgggtagccgcctgtcatggcccgaaagcgagggcaagcccagggtcaaggggtcaaagagcagcgccgggactggagcttcggtctctgccgccgccaccgccgccgccgccgggggagggggctctacagcttcgacctctggtggggtcggggctggggctggagcccgagggaagttgtcccctcggaaaggcaagagtaagaccttggacaacagtgacttgcatccgggaccgcctgccggctctcctcctccgctaaccctcccaccaactccgagtccagccactgctgtcaccgctgcttccgcgcagccccccgggcctgcacctccaatcactctggagcctccagctccggggctgaaacggggccgggaggggggccgagcatccactcgtgaccgcaagatgctcaagtttatcagcggcatcttcaccaagagcacaggagggcctcctggctccgggccccttcccggaccccccagcctgtcttctggcagcgggtccagggagctgctgggcgccgagctccgcgcttcccctaaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagccaagcgcaaaatgtggaaactaaaatcctttggtagtttaagaaatatttataaagcagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatag

SEQ ID NO: 339 - DNA, 3861 bp, Homo sapiens
agctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaa

SEQ ID NO: 340 - DNA, 2685 bp, Homo sapiens
ggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaagaataacaaaaagatggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatca

SEQ ID NO: 341 - DNA, 1429 bp, Homo sapiens
gggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtc

SEQ ID NO: 342 - DNA, 1406 bp, Homo sapiens
aagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggccttattttttgaacaattgagcaaaagaaacagatgaaacctcatacaaaaccctccaaaatatgaaaatgtggggtttatttgtgctaatgctcttcttttggaaacatttgtgttaaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctgtaagtattagtaaatcaactattactaacattcttttaaaaggctatacagtagtttgtgaatcttgacaaccaccagagggagcaagacgtcttccaaaacaaattcctactgcagtcaagtgcatcctggaaatgatagcaagaaggaaatagttcaagataagctctggtcacctctatagagttggt

SEQ ID NO: 343 - DNA, 6718 bp, Homo sapiens
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgttttttttttttaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtttagttttttgtttttactctaaagatagaattggggagtaaacttcagtttttgtttagagtggatctgaatatttaaaatcctataataatttttgtgaatcttcattctttgagtatgggattgtaaaagacaaactatatcctacagtagtatcatcatcagtatcaaaggtctcctttttttacttggaaaagtaattcacaaacattataaaaatactattcaaacagtaccaaagagtagattagcaaaagtaagtttttttccctagcctgtctcatttttccatcattacacagactacttggaatgtcttagatgtccttgtattgtaattttctgtgtaggtagaaataaatgtagctttcttattttacacaaataggaacttactgtatatactgttctgcactttgcttttattaaagatcttttgataaagaactatattgataagcagtaaagatgtcatgctcctggcccaataaaatattgttagcattgtcataaatatgtcttttccaccggcgatggttgggtagttaagtgaataagctagaaagacatgtttataaagctatttgatgacaatctcaggcatatttatacagagatgttcttaactgtttgctacaaaaacatgaagatcaaaaactttcttgaagcttacgcttaacttatttggggaaacaaaactccagcccttcttgtgtatgttctgatatccctttgctctacttttagaggagtgaaccctaataggatggtagcagcattcttgtttctttatatctctcctctgtgattgtataccgttttttcaacttaaagcaacttcagctggaaatatgtagaggttggccaaggtgaactaaatagtctgtaacattgattagatatcaagcaacgtgagcatggtagcaaaagcactaactgaagccagtgatttaatttttaattctgattctgataattgatgatatagctcctcgaactttgttttttgttaaaacttggaaaatatatttgtattattttggacaaattatttgaactctctggaccttgattcaatttatatataaggtaaaggcattatactggattatcctgcaatttctttgagttgttagaatataatgtagcttattaatagcaatattagcagtgtagtagattctgactgcaaaacctagccttttctattgattcattagtggtagtaaaggtattatctgatttatcctttttaataggcagtgctttgatcaagtgggaaatagtaatggacaaataaaatcaatgatcattatctaacttgatgcctgcttttcaaaaagtgagcaaatttcacatcttcacccttagacattaattcatggcacctactataagtactcatcctcttcttacctatcttcttttctataggagataaagtggttattcagaccccccaatacaattttttggtttgttttcacagctacttaaaagattaaaataactattcttgcagatatttctaggaatatttttagaaataatatgaaatacagggataataggccaattatgatctttatttttaatttctacagaaaagtactagagaatatatctatagaaacttctttcagataaccctaaagatgatactagaatgtttataaaattattgagaagattatttgtgttataaagcttatttgtaccatagtaaaggatgtttttgttcctcttcattctgggctaatctgtcaatactgaagtccagtcttttcccccttttcttaccagctcaaccttgattcctgtgacccattctttctgatctttcgtagttcatagtcaccaggcatgagtaccttggatagccctctgaagtctgttaccacccagatttccaactcgggttaattggtactaattctattagctggtataaataatccaaaatctgtgcagactctgggagcaaaatgttctactcagtttggaatactgtgccttaaaatatatttcattgtaacagcaccttgtatatatagttggccaaggacagagttgttacaagttacgtggaactttcatagcaaatcttgacagtaaataccttgttcttgtattaggtctatatcctgaattgacctttagcaagaatctttagatctgctggagggctgggatggcttttggacttcagtgaaaaagaatttctgctactcattgttgataacgcttcagtactgtataaatgtttatccttttccacgtaatttgttttctatgatatgagaacttttattataatttgcctcagtcttgatagaatcttaacaaaaataaaatctgtggtcgtctgaggtattctccatgctataacccagtttagctgatgcatttggagcttgggtgctgaaattaaatataacctatttgagttaaggatttattactagtgctccagtggtcacaggaacaataaaaaaggaacaacgatagaaatacgtgatctaggaaagaaggcaactgaaaaacctgaaagaaaaaaaatgaaagattaaaagtatacgatattctattttgatttagcaattacttgttttctagtgttctgtcaatttttggtgacttttataattacattaaaactaagatgctgaattaaaataaagtttctcttttattcaagcaccaacattcacttatattacctatatattgcatcaagttttgagccttcaatcccagaagcattgattgactgtctactgtggttcaagtactgtgcataaagatgaataaatattctgtccttggcttagtctaatagtaaaggcactcttagaggagggacaaatattttgcctagataagatttgagagatagtaagtgcggaatttctcttcataaaaatggtagtgttagttgtttagagggagaagtccagctatgtaaggtgaaagtggggcttataaaagtggatctattgtttaaaaattagtactttgctcctaaaatttttacctaagtgttacatccaacaacagatgaaagtaattcgacagtagcatctgctttattcatttcatatttccagtgcctgacatattgcttggcatatagtagtttagtggatgtgtttgatgaatgaatgagtaaaaattatttttcatgttaaaataaaactttgaattacatgagtatacaacttttgttccttcaaaatacccatatttgtcaaatatgaccgaattacgactttttttctgttccactagtttctaccttagaagtgacattctgcgtaaggtagtgggggattactaagtgatcatgacttttctgaagcaggtcttaaataattatctaagccttcagtcatttcaaaatctctgtagtgtaaatgatcacaggctctaaatcagattgttgtacaaggtaattgacatgtcctgaaatgtaacattcaacattaacagtagaaacaggcctcatttctccctctggcttttattgatcaattttgatattgtccagatcccatgttaaaccacttgatttagagatgacttaattctaaacttcctccatttttaattaataagattcaaggttgcagtaaattgttaatcttatttggaattatattagaaagtcgatatcggaattggaaccacacatctttttcttattgtgggtacatgggat

SEQ ID NO: 344 - DNA, 1381 bp, Homo sapiens
gggggtggtccccgggcccgacccatccggctttcctttccctccgcgcccgtttttgccagtcggtttggggacccaggggccgagctcggggactggcctggcaggggagctagaaaagagaagcgctcctggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtg

SEQ ID NO: 345 - DNA, 1417 bp, Homo sapiens
gaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttccttggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaaca

SEQ ID NO: 346 - DNA, 1557 bp, Homo sapiens
gctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggagggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgc

SEQ ID NO: 347 - DNA, 2254 bp, Homo sapiens
atagatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttct

SEQ ID NO: 348 - DNA, 2387 bp, Homo sapiens
cggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttct

SEQ ID NO: 349 - DNA, 2776 bp, Homo sapiens
gacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 350 - DNA, 2836 bp, Homo sapiens
cggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtccagagtggacaccggacaccttggccaagttgaatggtgcacagttctgagcaggcctgactcacgtttccttattgctgggatgttcacagagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttct

SEQ ID NO: 351 - DNA, 2736 bp, Homo sapiens
ggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttct

SEQ ID NO: 352 - DNA, 2788 bp, Homo sapiens
gacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccagtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 353 - DNA, 2746 bp, Homo sapiens
cggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 354 - DNA, 2745 bp, Homo sapiens
gtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctat

SEQ ID NO: 355 - DNA, 739 bp, Homo sapiens
gagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaacttgttgacttttcgtttgattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaa

SEQ ID NO: 356 - DNA, 519 bp, Homo sapiens
cgggcgttcggattggctggcgggaagaggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagct

SEQ ID NO: 357 - DNA, 571 bp, Homo sapiens
accctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtggtgctggctagagtgtatacgtttggacccaagcttaacttttccaatgtggaatcctgggccttcattgatcatccaatggcagaccagagaatggacatttcttcaaccatcagtgatttcatgtccccgggccccaccgacctg

SEQ ID NO: 358 - DNA, 610 bp, Homo sapiens
tttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattgatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaa

SEQ ID NO: 359 - DNA, 551 bp, Homo sapiens
gtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattgatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacag

SEQ ID NO: 360 - DNA, 868 bp, Homo sapiens
gaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtgatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccag

SEQ ID NO: 361 - DNA, 567 bp, Homo sapiens
ggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaac

SEQ ID NO: 362 - DNA, 807 bp, Homo sapiens
accctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaag

SEQ ID NO: 363 - DNA, 4243 bp, Homo sapiens
gcttccggtgcgggccccgccccggctgtggcccccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaa

SEQ ID NO: 364 - DNA, 1599 bp, Homo sapiens
ctggctggcggtccagccccgcggcgccgcttccggtgcgggccccgccccggctgtggcccccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatctgggacgtggtgccagtgaggagcccagttggctggcactgggcccatttga

SEQ ID NO: 365 - DNA, 1719 bp, Homo sapiens
agtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacac

SEQ ID NO: 366 - DNA, 8249 bp, Homo sapiens
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 367 - DNA, 8056 bp, Homo sapiens
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaat

SEQ ID NO: 368 - DNA, 13147 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagaatacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 369 - DNA, 1511 bp, Homo sapiens
agattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgt

SEQ ID NO: 370 - DNA, 12954 bp, Homo sapiens
gcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagaatacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcata

SEQ ID NO: 371 - DNA, 4841 bp, Homo sapiens
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtgggtgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcag

SEQ ID NO: 372 - DNA, 481 bp, Homo sapiens
aaaagaagccgtggccgcgggaggaggcgagaggagtcgggatctgcgctgcagccaccgccgcggttgatactactttgaccttccgagtgcagtgtctcgctctgtcgcccatgctggagtgcaattgcgtgatctcagctaactgcactttccgcctcctgggttcaaacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaaga

SEQ ID NO: 373 - DNA, 1205 bp, Homo sapiens
ggggcggagctggagggggtggttcggcgtgggggccgttggctccagacaaataaacatggagtccatcttccacgagaaacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaata

SEQ ID NO: 374 - DNA, 6947 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaggatcagcacttccatattttaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 375 - DNA, 4713 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctc

SEQ ID NO: 376 - DNA, 6938 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaatgactactttgattcacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 377 - DNA, 6902 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaggatcagcacttccatattttaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 378 - DNA, 6950 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagacagagtctcgctctgtcgcccaggcacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 379 - DNA, 1315 bp, Homo sapiens
tggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaata

SEQ ID NO: 380 - DNA, 1191 bp, Homo sapiens
acaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaa

SEQ ID NO: 381 - DNA, 6956 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagtttgggaggccaaggcgggcagattgcctgagacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 382 - DNA, 6896 bp, Homo sapiens
gactccgtctcaaaaaaaaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagaaatttacagcaaataggacggatcagcacttccatattttaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 383 - DNA, 6962 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaggtattttttaaaaatttacagcaaataggacgggcacgacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 384 - DNA, 6950 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 385 - DNA, 6971 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaggtattttttaaaaatttacagcaaaatcagcacttccatattttaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 386 - DNA, 1259 bp, Homo sapiens
gtgggggccgttggctccagacaaataaacatggagtccatcttccacgagaaaaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttca

SEQ ID NO: 387 - DNA, 4339 bp, Homo sapiens
ccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggc

SEQ ID NO: 388 - DNA, 4318 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagt

SEQ ID NO: 389 - DNA, 3535 bp, Homo sapiens
gtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtg

SEQ ID NO: 390 - DNA, 4352 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagt

SEQ ID NO: 391 - DNA, 2974 bp, Homo sapiens
gacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacaggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatt

SEQ ID NO: 392 - DNA, 2214 bp, Homo sapiens
accttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 393 - DNA, 1931 bp, Homo sapiens
attttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 394 - DNA, 1793 bp, Homo sapiens
cattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 395 - DNA, 1945 bp, Homo sapiens
tctggcattgcaagcctcgcttcgttgccacttcccagctcttcccgccttccgcggtataatcaacactacgagagatagagccgcctagaaccagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagtt

SEQ ID NO: 396 - DNA, 1916 bp, Homo sapiens
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 397 - DNA, 2184 bp, Homo sapiens
agtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 398 - DNA, 4645 bp, Homo sapiens
tattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactgg

SEQ ID NO: 399 - DNA, 345 bp, Homo sapiens
ctactttattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaag

SEQ ID NO: 400 - DNA, 461 bp, Homo sapiens
tcattactctttacctgtgaagagtagaacatgaagaaatctactttattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaag

SEQ ID NO: 401 - DNA, 3797 bp, Homo sapiens
gctctctctcctgtcatgggtgtaagtgcaggatactggcccaaaatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacat

SEQ ID NO: 402 - DNA, 3651 bp, Homo sapiens
atggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccagtgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtga

SEQ ID NO: 403 - DNA, 6369 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 404 - DNA, 6396 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 405 - DNA, 6219 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 406 - DNA, 6387 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 407 - DNA, 6594 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 408 - DNA, 6552 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatatttta

SEQ ID NO: 409 - DNA, 5869 bp, Homo sapiens
tgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttct

SEQ ID NO: 410 - DNA, 4479 bp, Homo sapiens
actgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattata

SEQ ID NO: 411 - DNA, 4276 bp, Homo sapiens
gaaaaaaggaacccaaggagataggagagctgttaatttcactcgggacatttcctcgaggctagtttactcggaaagcctcaatgttccctggtagctgcaggatctactttgggggctgccaagtttcctctctcattctttctcctgccccaagagcaggcaggaaggaaagttcctggactgatactcgtctgtttagtaggcgtgggtcctggttgaagtctgtctaggaaaactcctaagtgtagaaatcttcttcgtattaccactgtctctgcactgagatttgggctgctttgcttccagcgtcacacatcataactgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatccta

SEQ ID NO: 412 - DNA, 2223 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 413 - DNA, 2248 bp, Homo sapiens
ggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 414 - DNA, 2112 bp, Homo sapiens
cttggaagacttgggtccttgggtcgcaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 415 - DNA, 1902 bp, Homo sapiens
gaattctaacggctgagctcttggaagacttgggtccttgggtcgcaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggtaagacgcaactgaaaaggacccagcacatctgctggaattctttccttatcagcctgaactgcaggccaagatccgaacatctatactatttgatctctctaacctgtgttttgtgatattttatcatttgttgtactccaggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacaga

SEQ ID NO: 416 - DNA, 2547 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtct

SEQ ID NO: 417 - DNA, 2145 bp, Homo sapiens
gaattctaacggctgagctcttggaagacttgggtccttgggtcgcaggtgggagccgacgggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 418 - DNA, 2169 bp, Homo sapiens
cttaaacgcgactcaaggcgtcgggtttgttgtcaaccaatcacaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 419 - DNA, 2238 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcaggtgggagccgacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtct

SEQ ID NO: 420 - DNA, 2114 bp, Homo sapiens
cacaaggcagcctcgctcgagcgcaggccaatcggctttctagctagagggtttaactcctatttaaaaagaagaacctttgaattctaacggctgagctcttggaagacttgggtccttgggtcgcaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 421 - DNA, 879 bp, Homo sapiens
aatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcg

(The sequence listing continues in the following parts.)

We claim:

1. An mRNA encoding SEQ ID NO: 8328, wherein said mRNA comprises a coding region, said coding region having at least 80% identity to SEQ ID NO: 33555.

2. The mRNA of claim 1, wherein the mRNA comprises at least one untranslated region 5' relative to the coding region and at least one untranslated region 3' relative to the coding region.

3. The mRNA of claim 2, wherein the 5' untranslated region is heterologous to the coding region of the mRNA.

4. The mRNA of claim 2, wherein the 3' untranslated region is heterologous to the coding region of the mRNA.

5. The mRNA of claim 2, wherein the 5' untranslated region and the 3' untranslated region are heterologous to the coding region of the mRNA.

6. The mRNA of claim 2, wherein the mRNA comprises at least two stop codons.

7. A pharmaceutical composition comprising the mRNA of claim 1 and a pharmaceutically acceptable excipient.

8. The pharmaceutical composition of claim 7 wherein the pharmaceutically acceptable excipient is selected from a solvent, aqueous solvent, non-aqueous solvent, dispersion media, diluent, dispersion, suspension aid, surface active agent, isotonic agent, thickening or emulsifying agent, preservative, lipid, lipidoids liposome, lipid nanoparticle, core-shell nanoparticles, polymer, lipoplex, peptide, protein, cell, hyaluronidase, and mixtures thereof.

9. The mRNA of claim 1, wherein the coding region is selected from the group consisting of SEQ ID NO: 33555, 33620, 33582, 33560, 33588, 33590, 33589 and 33553.

10. A method of producing a protein of interest in a cell, tissue or organism comprising contacting said cell, tissue or organism with the mRNA of claim 1.

11. The method of claim 10, wherein the mRNA comprises at least one untranslated region 5' relative to the coding region and at least one untranslated region 3' relative to the coding region.

12. The method of claim 11, wherein the 5' untranslated region is heterologous to the coding region of the mRNA.

13. The method of claim 11, wherein the 3' untranslated region is heterologous to the coding region of the mRNA.

14. The method of claim 11, wherein the 5' untranslated region and the 3' untranslated region are heterologous to the coding region of the mRNA.

15. The method of claim 11, wherein the mRNA comprises at least two stop codons.

* * * * *